(12) United States Patent
Weill et al.

(10) Patent No.: US 8,673,568 B2
(45) Date of Patent: Mar. 18, 2014

(54) **MOLECULAR TYPING AND SUBTYPING OF *SALMONELLA* BY IDENTIFICATION OF THE VARIABLE NUCLEOTIDE SEQUENCES OF THE CRISPR LOCI**

(75) Inventors: François-Xavier Weill, Paris (FR);
Laetitia Fabre, Pontchartrain (FR);
Véronique Guibert, Vernouillet (FR);
Laure Diancourt, Herslay (FR); Sylvain Brisse, Clamart (FR)

(73) Assignee: Institut Pasteur, Paris (FR)

( * ) Notice: Subject to any disclaimer, the term of this patent is extended or adjusted under 35 U.S.C. 154(b) by 537 days.

(21) Appl. No.: 12/811,055

(22) PCT Filed: Dec. 29, 2008

(86) PCT No.: PCT/IB2008/004004
§ 371 (c)(1),
(2), (4) Date: Oct. 25, 2010

(87) PCT Pub. No.: WO2009/115861
PCT Pub. Date: Sep. 24, 2009

(65) Prior Publication Data
US 2012/0088676 A1 Apr. 12, 2012

(30) Foreign Application Priority Data
Dec. 28, 2007 (FR) ...................................... 07 09188

(51) Int. Cl.
*C12Q 1/68* (2006.01)
*C12P 19/34* (2006.01)

(52) U.S. Cl.
USPC ......................................... 435/6.12; 435/91.2

(58) Field of Classification Search
None
See application file for complete search history.

(56) References Cited

U.S. PATENT DOCUMENTS

2006/0177824 A1* 8/2006 Procop ............................... 435/6
2008/0124725 A1* 5/2008 Barrangou et al. ............... 435/6

FOREIGN PATENT DOCUMENTS

WO WO-99/51771 10/1999
WO WO-2007/136815 A2 11/2007

OTHER PUBLICATIONS

Witonski et al., "Variable-Number Tandem Repeats that are Useful in Genotyping Isolates of *Salmonella enterica* subsp. *enterica* Serovars Typhimurium and Newport," Journal of Clinical Microbiology, vol. 44, No. 11, pp. 3849-3854, (2006).
Lindstedt et al., "Multiple-Locus Variable-Number Tandem-Repeats Analysis of *Salmonella enterica* subsp. *enterica* Serovar Typhimurium using PCR Multiplexing and Multicolor Capillary Electrophoresis," Journal of Microbiological Methods, vol. 59, pp. 163-172, (2004).
Liu et al., "Molecular Typing of *Salmonella enterica* Serovar Typhi Isolates from Varios Countries in Asia by Multiplex PCR Assays on Variable-Number Tandem Repeats," Journal of Clinical Microbiology, vol. 41, No. 9, pp. 4388-4394, (2003).
Ramisse et al., "Variable Number of Tandem Repeats in *Salmonella enterica* Subsp. *enterica* for Typing Purposes," Journal of Clinical Microbiology, vol. 42, No. 12, pp. 5722-5730, (2004).
Pourcel et al., "CRISPR Elements in *Yersinia pestis* Acquire New Repeats by Preferential Update of Bacteriophage DNA, and Provide Additional Tools for Evolutionary Studies," Microbiology, vol. 151, pp. 653-663, (2005).
Nakata et al., "Unusual Nucleotide Arrangement with Repeated Sequences in the *Escherichia coli* K-12 Chromosome," Journal of Bacteriology, vol. 171, No. 6, pp. 3553-3556, (1989).
Jansen et al., "Identification of Novel Family of Sequence Repeats Among Prokaryotes," OMICS A Journal of Integrative Biology, vol. 6, No. 1, pp. 22-33, (2002).
Godde et al., "The Repetitive DNA Elements called CRISPRs and Their Associated Genes: Evidence of Horizontal Transfer Among Prokaryotes," Journal of Molecular Evolution, vol. 62, pp. 718-729, (2006).
Grissa et al., "CRISPRFinder: A Web Tool to Identify Clustered Regulary Interspaced Short Palindromic Repeats," Nucleic Acids Research, vol. 35, pp. W52-W57, (2007).
Groenen et al., "Nature of DNA Polymorphism in the Direct Repeat Cluster of *Mycobacterium Tuberculosis*; Application for Strain Differentation by a Novel Typing Method," Molecular Microbiology, vol. 10, No. 5, pp. 1507-1065, (1993).
Grimont et al., "Centre National De Références Des *Salmonella*," Rapport d'activité annuel, pp. 28 and 43, (2005).
International Search Report from the European Patent Office for International Application No. PCT/IB2008/004004 (Mail date: Feb. 12, 2010).

* cited by examiner

*Primary Examiner* — Kenneth R. Horlick
*Assistant Examiner* — David Thomas
(74) *Attorney, Agent, or Firm* — Finnegan, Henderson, Farabow, Garrett & Dunner LLP

(57) ABSTRACT

The present invention relates to a method for detecting and identifying bacteria of the *Salmonella* genus by identification of the variable nucleotide sequences contained in the CRISPR loci of these bacteria, and also to diagnostic reagents, such as oligonucleotide primers and probes, for molecular typing and subtyping of these bacteria.

17 Claims, 89 Drawing Sheets

A
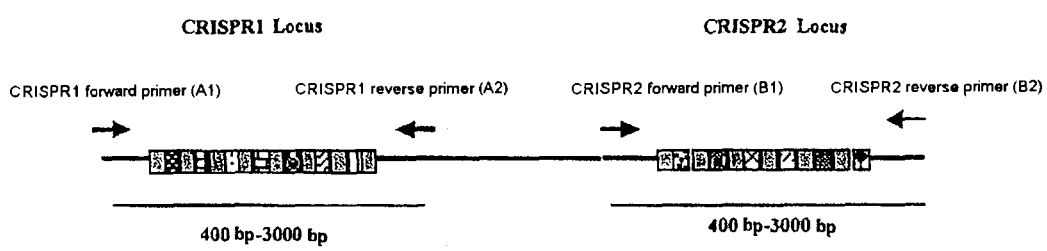
B
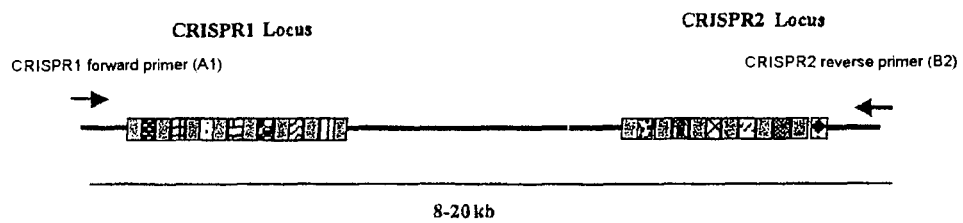
FIGURE 1

6A
TGCCAGGGCGAATTGAGCGCCGTAGCCGCGATGTAGTACGGATAATGCTGCCGTTGGTAAAAGAG
CTGGCGAAGGCGGAAAAAACGTCCTGATATGCTGGTGAAACGTGTTTATCCCCGCTGACGCGGGGA
ACACTATTTATAAGCGTGTCATCTATGCAACCCAACCGGTTTATCCCCGCTGGCGCGGGGAACACA
CCTGCCCGACCCAATAAGGGGGCCCTCGTGACGGTTTATCCCCGCTGGCGCGGGGAACACGGCCG
CTGGTCAAATTCCCAATCTGAGCAATCCGGTTTATCCCCGCTGGCGCGGGGAACACATAGCCCCGG
CAGCGATAGCTAAACCAGTTCCCGGTTTATCCCCGCTGGCGCGGGGAACACGCCTCAAAATCTCTC
GGTGAGATGTAAGCGTCCGGTTTATCCCCGCTGGCGCGGGGAACACACCAGTGGTCAGCGGCGGA
TGAATTTGCCCTGCGGTTTATCCCCGCTGGCGCGGGGAACACGAGAATGCTCATGCGCGTGAGCGC
CATATATTCGGTTTATCCCCGCTGGCGCGGGGAACACAGGCGGACCGAAAAACCGTTTTCAGCCA
ACGTCGGTTTATCCCCGCTGGCGCGGGGAACACACTAAAACTATATATTTGTTCTAAAAGCCCTTTT
TTACTACATAACAAACTACCAACGGTAAGATAACAATTCCTTATCATTAAAGAACATTCAACTTAT
TGATTTTCAACAGGAAGAAAAGAAACCAAACGCAGTCCATCCAAATCTACCGGAATACG

6B
CCCCGGGAAAACGCGGCCTTTTTACTTTACAGGTTTGTACCAGCCATTACTGGTACACAGATTATGA
TTATGCAACGGCTATCCTTGTTGGCGCGGGGAACACGGCTACACGCAAAAATTCCAGTCGTTGGCG
CACGGTTTATCCCCGCTGGCGCGGGGAACACCCGATTAAGATCCGCAGTCTGCATCAGTAACTCGG
TTTATCCCCGCTGGCGCGGGGAACACCGATTCTACGGCAACAGGCCAGGCTGCGACCGCGGTTTAT
CCCCGCTGGCGCGGGGAACACATCAAACATGGAAACCCCTTTAATGAGAGCAACGGTTTATCCCCG
GCTGGCGCGGGGAACACTCAGGAACGCGCGGCGGAAGAGCTTGGTGTTTGCGGTTTATCCCCGCT
GGCGCGGGGAACACGCTGCCTTTCCCGGAGTTCCGGCCCCTAAATTGGGTTTATCCCCGCTGGCGC
GGGGAACACTCATGCGCTATAAAAATCAGACTGTCACATGCCGGTTTATCCCCGCTGGCGCGGGGA
ACACTGATTATTGACGACAACAGCACAGACCGGCAGCAGTTTATCCCCGCTGGCGCGGGGAACAC
AATAATCGGCAATTTGTCCTGGACAGGCACGGCAGTTTATCCCCGCTGGCGCGGGGAACACGAAT
CTGGAGGCCAACAGCGCGGCGAAATCCTCAGTTTATCCCCGCTGGCGCGGGGAACACACTAAACG
TATGTCATTGTTTATAAACTACTTTTTATCAGCACCACATTCCACCAACATAATCGCAACAATTTAA
ATTATTAAAGAACAGCTAATTTGCTGATTTTGATGCAAAAAAGTTCATAGAATGATTTTTTCTTTAA
ATTTACCAAAATAGCGCGATCCGTGCATCGCTATGGAAAAATTTATCAGCGCTTTTATACACTCATC
GAAATTCACATAGAGAAAATAAACAATGCAAGGTAATGGATGAGTCACAGACGGCATC

FIGURE 6

7A
GAGCGCCGTAGCCGCGATGTAGTACGGATAATGCTGCCGTTGGTAAAAGAGCTGGCGAAGGCGGA
AAAAACGTCCTGATATGCTGGTGAAACGTGTTTATCCCCGCTGACGCGGGGAACACTATTTATAAG
CGTGTCATCTATGCAACCCAACCGGTTTATCCCCGCTGGCGCGGGGAACACACCTGCCCGACCCAA
TAAGGAGGCCCTCGTGACGGTTTATCCCCGCTGGCGCGGGGAACACGGCCGCTGGTCAAATTCCC
AATCTGAGCAATCGGGTTTATCCCCGCTGGCGCGGGGAACACATAGCCCCGGCAGCGATAGCTAA
ACCAGTTCCCGGTTTATCCCCGCTGGCGCGGGGAAGACGCCTCAAAATCTCTCGGTGAGATGTAAG
CGTCCGGTTTATCCCCGCTGGCGCGGGGAACACACCAGTGGTCAGCGGCGGATGAATTTGCCCTGC
GGTTTATCCCCGCTGGCGCGGGGAACACGAGAATGCTCATGCGCGTGAGCGCCATATATTCGGTTT
ATCCCCGGCTGGCGCGGGGAACACCATGGCAATTTTACGGCGGACGTGCTCGCTCTCGGTTTATCCC
CGCTGGCGCGGGGAACACAGGCGGACCGAAAAACCGTTTTCAGCCAACGTCGGTTTATCCCCGGCT
GGCGCGGGGAACACACTAAAACTATATATTTGTTCTAAAAGCCCTTTTTTACTACATAACAAACTA
CCAACGGTAAGATAACAATTCCTTATCATTAAAGAACATTCAACTTATTGATTTTCAACAGGAAGA
AAAGAAACCAAACGCAGTCCATCCAAATCTACCGGAATACG

7B
TGTAGAAAAGCCTCCCCCGGGAAAACGCGGCCTTTTTACTTTACAGGTTTGTACCAGCCATTACTG
GTACACAGATTATGATTATGCAACGGCTATCCTTGTTGGCGCGGGGAACACGGCTACACGCAAAA
ATTCCAGTCGTTGGCGCACGGTTTATCCCCGCTGGCGCGGGGAACACCCGATTAAGATCCGCAGTC
TGCATCAGTAACTCGGTTTATCCCCGCTGGCGAGGGGAACACCGATTCTACGGCAACAGGCCAGG
CTGCGACCGCGGTTTATCCCCGCTGGCGCGGGGAACACATCAAACATGGAAACCCCTTTAATGAG
AGCAACGGTTTATCCCCGCTGGCGCGGGGAACACTCAGGAACGCGCGGCGGAAGAGCTTGGTGTT
TGCGGTTTATCCCCGCTGGCGCGGGGAACACGCTGCCTTTCCCGGAGTTCCGGCCCCTAAATTGGG
TTTATCCCCGCTGGCGCGGGGAACACTCATGCGCTATAAAAATCAGACTGTCACATGCCGGTTTAT
CCCCGCTGGCGCGGGGAACACTGATTATTGACGACAACAGCACAGACCGGCAGCAGTTTATCCCC
GCTGGCGCGGGGAACACAATAATCGGCAATTTGTCCTGGACAGGCACGGCAGTTTATCCCCGCTGG
CGCGGGGAACACAATAATCGGCAATTTGTCCTGGACAGGCACGGCAGTTTATCCCCGCTGGCGCGG
GGAACACGAATCTGGAGGCCAACAGCGCGGCGAAATCCTCAGTTTATCCCCGCTGGCGCGGGGAA
CACACTAAACGTATGTCATTGTTTATAAACTACTTTTTATCAGCACCACATTCCACCAACATAATCG
CAACAATTTAAATTATTAAAGAACAGCTAATTTGCTGATTTTGATGCAAAAAAGTTCATAGAATGA
TTTTTTCTTTAAATTTACCAAAATAGCGCGATCCGTGCATCGCTATGGAAAAATTTATCAGCGCTTT
TATACACTCATCGAAATTCACATAGAGAAAATAAACAATGCAAGGTAATGGATGAGTCACAGACG
GCAT

FIGURE 7

CGGGAGTGAGCGCCGTGCCGCGAGTAGTGCGGATAATGCTGCCGTTGGTAAAAGAGCTGGCGAAG
GCGGAAAAAACGTCCTGATATGCTGGTGAAACGTGTTTATCCCCGCTGGCGCGGGGAACATTTTTC
AGCCCTTGTCGACTGCGGAACGCCCCTCGGTTTATCCCCGCTGGCGCGGGGAACACGCGAAATAGT
GGGGAAAAACCCCTGGTTAACCCGGTTTATCCCCGCTGGCGCGGGAAACACTAGGCCTTGATACC
ATCGCTCGCACCTCGTCACGGTTTATCCCCGCTGGCGCGGGGAACACGTTTATTACTGCTTAGTTA
ATTAATGGGTTGCCGGTTTATCCCCGCTGGCGCGGGGAACACAGGCGAATAATCTCTAATAGTCTC
AATTCGTTCGGTTTATCCCCGCTGGCGCGGGGAACACTAAATCTGGCGTCGAGACATTCGAAATAG
TGCCGGTTTATCCCCGCTGGCGCGGGGAACACTCTTTTGATTTTGCTGCGATGTTATAACCAGACG
GTTTATCCCCGCTGGCGCGGGGAACACTATCCACATATACCCGCAATCATATTCAAGAACGGTTTA
TCCCCGCTGGCGCGGGGAACACAATCACTGCGGGGTATTTAGCGGAAACGGCTCGGTTTATCCCC
GCTGGCGCGGGGAACACCAGCACGAAAAATTATTTACTGTCGTTGCTCACGGTTTATCCCCGCTGG
CGCGGGAACACACTAAAACTATATATTTGTTCTAAAAGCCCTTTTTTACTACATAACAACTACCA
ACGGTAGATAACAATTCCTTATTATTAAAGACATTCAACTTATTGATTTTCAACAGGAAGAAAAGA
AACCCAAACGCAGTCCATCCAAA

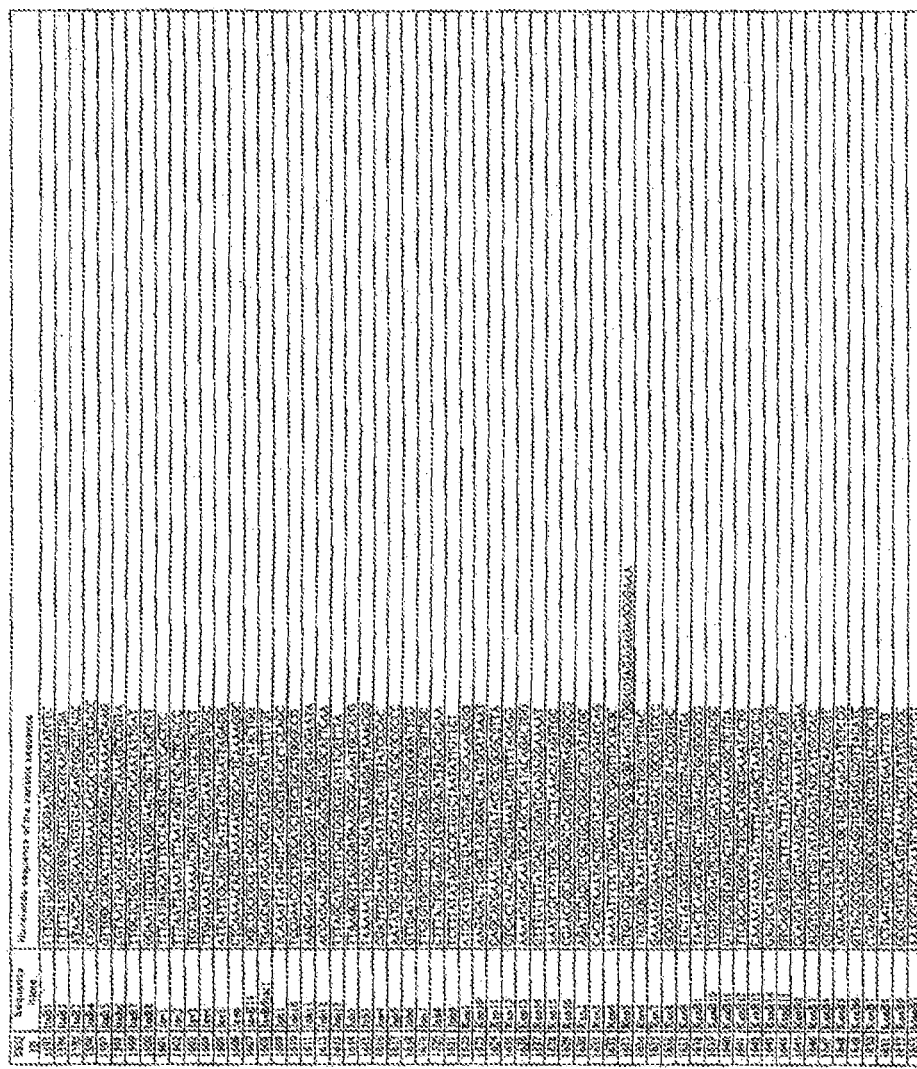

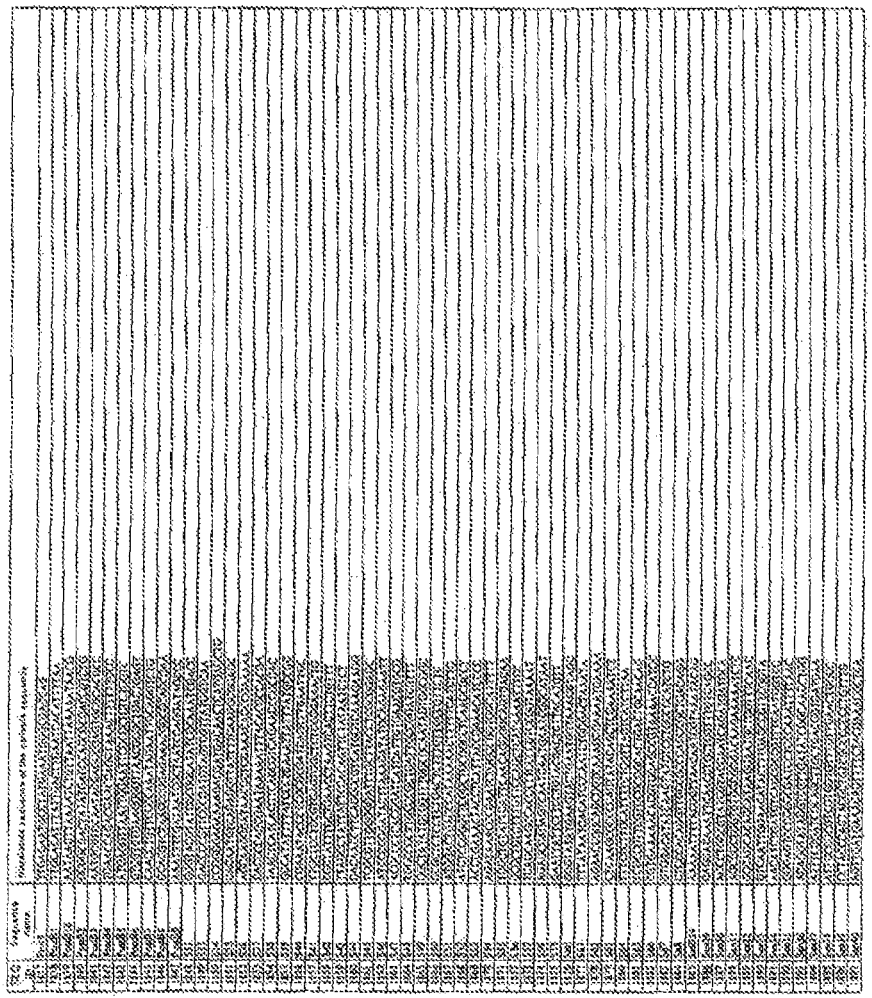

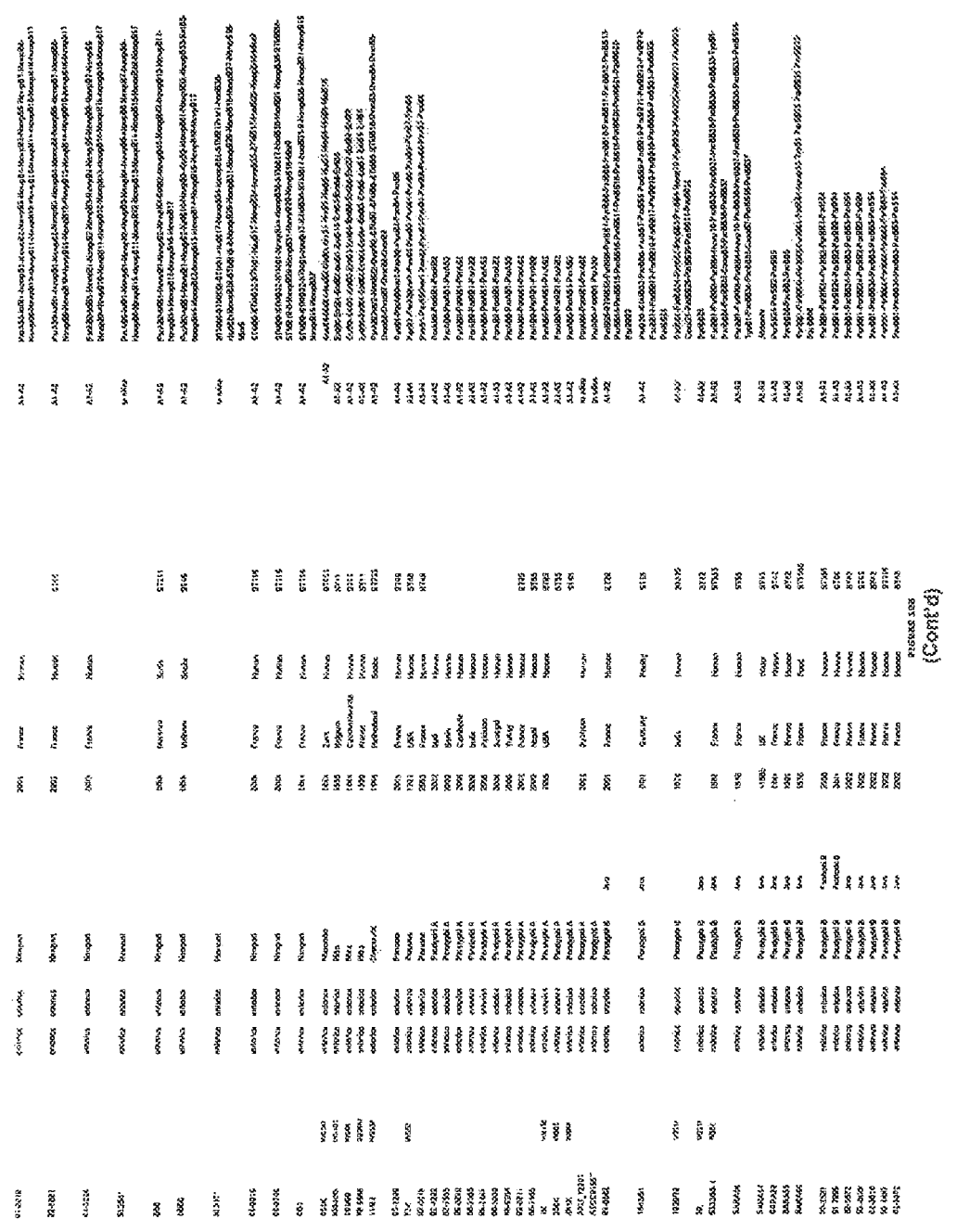

MOLECULAR TYPING AND SUBTYPING OF SALMONELLA BY IDENTIFICATION OF THE VARIABLE NUCLEOTIDE SEQUENCES OF THE CRISPR LOCI

SEQUENCE LISTING

The instant application contains a "lengthy" Sequence Listing which has been submitted via CD-R in lieu of a printed paper copy, and is hereby incorporated by reference in its entirety. Said CD-R, recorded on Nov. 15, 2011, are labeled CRF, "Copy 1" and "Copy 2", respectively, and each contains only one identical 533,358 bytes file (03495044.txt).

The present invention relates to the detection and identification of bacteria of the *Salmonella* genus, and also to diagnostic reagents, such as oligonucleotide primers and probes, for molecular typing and subtyping of these bacteria.

Salmonelloses are the primary cause of bacterial diarrhea of food origin in industrialized countries. The Institut de Veille Sanitaire [French Institute for Public Health Surveillance] estimated in 2004 that 30 000 to 40 000 confirmed cases of salmonellosis lead to 100 to 500 deaths annually in France. Owing to a vast animal reservoir, animal and human salmonelloses also constitute a considerable economic cost for the food-processing industry. Testing for *Salmonella* is therefore carried out throughout the food chain, from the livestock to the final food product. In the event of a positive *Salmonella* sample, a more precise typing of the salmonella is carried out by serotyping.

*Salmonella* serotyping is currently based on the recognition of bacterial antigens (a wall antigen and one or two flagellar antigens) using a battery of polyclonal antibodies prepared in the rabbit. More than 2500 serotypes have already been described in *Salmonella*. Serotyping is a lengthy (approximately 3 to 6 days in order to obtain a result) and expensive (high cost of sera and considerable labor costs since it is a manual method) technique. In addition, in order to be able to serotype all the 2500 serotypes, it is necessary to be able to have approximately 200 rabbit sera (a large part of which are not commercially available). Serotyping is important not only in the medical field, since it makes it possible to detect epidemics, but also in the food sector since it makes it possible to trace the strains responsible for food contamination.

Moreover, owing to the predominance of certain *Salmonella* serotypes (Typhimurium and Enteridis represent by themselves 70% of the *Salmonella* detected in France each year), it is necessary to use more discriminating methods for tracing a particular strain belonging to these serotypes. These "subtyping" methods, which use, for example, pulse-field electrophoresis, phage typing, or a study by VNTR (acronym for "Variable Number of Tandem Repeats", Lindstedt et al., 2003, J. Clin. Microbiol. 14, 1469-1479), are laborious from a technical point of view and require several additional days of manipulation.

The presence of a family of repeat sequences of genomic DNA, called CRISPR (acronym for "Clustered Regularly Interspaced Short Palindromic Repeats") has been identified in many procaryotic organisms by Jansen et al. (2002, Mol. Microbiol. 43, 1565-1575). A CRISPR locus is characterized by noncontiguous repeat sequences (or DRs) generally of 21 to 37 base pairs (bp), separated by unique sequences, generally of 20 to 40 base pairs, called variable sequences (or alternatively spacers). The number of repeat sequences within a CRISPR locus, the number of CRISPR loci (1 to 2 *Salmonella*) or else the presence of CRISPR loci can vary within the same bacterial species (van Embden et al., 2000, J. Bacteriol. 182, 2393-2401).

The CRISPR loci have therefore been used to type bacterial strains by the technique called spoligotyping or "CRISPR locus spacer oligonucleotide typing" (Kamerbeek et al., 1997, J. Clin. Microbiol. 43, 907-914; Hoe et al., 1999, Emerg. Infect. Dis. 5, 254-263). This technique consists in amplifying the CRISPR locus by PCR using oligonucleotide primers complementary to genomic DNA regions located only in the repeat sequences (DR) of the CRISPR loci. The presence or absence of the variable sequences (spacers) in the amplification product is then determined using a DNA chip to which are attached probes capable of hybridizing to these variable sequences.

Molecular typing and subtyping by spoligotyping have thus been described for various bacterial species, such as *Mycobacterium tuberculosis* (Kamerbeek et al., 1997, mentioned above; Song et al., 2007, J. Microbiol. Methods, 68, 430-433) and *Corynebacterium diphtheriae* (Mokrousov et al., 2005, J. Clin. Microbiol. 43, 1662-1668).

The principle of a method for differentiating bacterial strains of the *Salmonella* genus by spoligotyping has been described in very general terms in international application WO 99/51771. However, this application does not disclose the nucleotide sequences of the variable sequences that can be used for detecting the various *Salmonella* types or subtypes.

Pourcel et al. (2005, Microbiology 151, 653-663) have, moreover, described a method of phylogenetic analysis of bacterial strains of the *Yersinia pestis* species based on the study of the polymorphism of the CRISPR loci of these strains. This method comprises the PCR amplification of the CRISPR loci of *Y. pestis* strains using oligonucleotide primers complementary to a genomic DNA sequence adjacent to the CRISPR loci of *Y. pestis* and *Y. pseudotuberculosis*, and then the analysis of the arrangement of the variable sequences contained in these loci.

The use of the spoligotyping technique has several drawbacks. This is because, given that regions of the repeat sequences of the CRISPR loci serve as complementary strand to which the oligonucleotide primers hybridize during the PCR reaction, the amplification product consequently contains a mixture of DNA fragments of different sizes comprising from one to all the variable sequences (spacers) of a CRISPR locus. As a result, the identification of the order of the spacers and of the presence of new spacers in a CRISPR locus cannot be carried out by this method since the sequencing of this mixture of amplified DNA fragments proves to be impossible. In addition, since the oligonucleotide primers are specific for a repeat sequence of a given serotype, it is not only necessary to have several pairs of primers for identifying various serotypes, but also impossible to detect, by hybridization, serotypes having repeat sequences different from those for which the primers were designed.

The present invention has given itself the aim of providing a method which meets practical needs more successfully than the prior art methods, in particular in that the molecular typing and/or subtyping of bacteria of the *Salmonella* genus are rapid and can be readily automated.

Thus, the inventors have designed oligonucleotide primers in such a way as to amplify, by PCR, fragments of the genomic sequence of various strains of *Salmonella*; these fragments comprise one of the two, or both, CRISPR loci. These primers do not hybridize to a region of the repeat sequences located inside the CRISPR loci, but hybridize to a genomic sequence located outside these loci. The inventors have subsequently sequenced the amplified DNA fragments so as to identify the various variable sequences (spacers) in each CRISPR locus and thus determine their variable-sequence compositions.

The inventors have thus analyzed 564 *Salmonella* strains belonging to 86 serotypes of the two species and six subspecies of *Salmonella* (as identified by conventional serotyping methods), including those which are found most commonly in humans and animals and in foods. These serotypes belong to the two species of *Salmonella*: *S. enterica* (and its six subspecies: *arizonae, diarizonae, enterica, houtenae, indica, salamae*) and *S. bongori*. On the basis of the CRISPR loci of these strains, the inventors have identified approximately 2150 different variable sequences, having an average size of 34 nucleotides.

Surprisingly, the inventors have observed that the presence (from 1 to 30 per CRISPR locus) or the absence of certain variable sequences and also their arrangement in the CRISPR loci were characteristic of a serotype. Similarly, when several strains of the same serotype were studied, the variable-sequence composition could vary between the strains (loss of certain variable sequences or acquisition of new variable sequences). The inventors have also shown that this variability within the same serotype was in agreement with the conventional methods of subtyping.

The subject of the present invention is therefore an in vitro method for molecular typing and/or subtyping of a bacterium of the *Salmonella* genus, using a sample, said method being characterized in that it comprises at least the following steps:

(a) amplifying a nucleic acid fragment from a bacterium of the *Salmonella* genus, said fragment comprising the CRISPR1 locus and/or the CRISPR2 locus, using at least one set of primers, which primers have a size of less than or equal to 50 nucleotides, said sets of primers being chosen from the group constituted of:

a set of primers "A" capable of amplifying a nucleic acid fragment comprising the CRISPR1 locus, comprising at least one forward primer A1 constituted of an oligonucleotide sequence which exhibits at least 70%, preferably 80%, 85%, 95%, more preferably 99% identity with, or which is identical to, a fragment of the genomic sequence of a bacterium of the *Salmonella* genus located in a region of 1000 by in a position 5' of the CRISPR1 locus, said fragment of the genomic sequence located in a position 5' of the CRISPR1 locus being of the same size as said primer A1, and at least one reverse primer A2 constituted of an oligonucleotide sequence which exhibits 70%, preferably 80%, 85%, 95%, more preferably 99% identity with, or which is identical to, a fragment of the genomic sequence complementary to the genomic sequence of a bacterium of the *Salmonella* genus located in a position 3' of the CRISPR1 locus and in a position 5' of the CRISPR2 locus, preferably in a region of 1000 by in a position 3' of the CRISPR1 locus, said fragment of the complementary genomic sequence being of the same size as said primer A2;

a set of primers "B" capable of amplifying a nucleic acid fragment comprising the CRISPR2 locus, comprising at least one forward primer B1 constituted of an oligonucleotide sequence which exhibits at least 70%, preferably 80%, 85%, 95%, more preferably 99% identity with, or which is identical to, a fragment of the genomic sequence of a bacterium of the *Salmonella* genus located in a position 3' of the CRISPR1 locus and in a position 5' of the CRISPR2 locus, preferably in a region of 1000 by in a position 5' of the CRISPR2 locus, said fragment of the genomic sequence located in a position 3' of the CRISPR1 locus and in a position 5' of the CRISPR2 locus being of the same size as said primer B1, and at least one reverse primer B2 constituted of an oligonucleotide sequence which exhibits at least 70%, preferably 80%, 85%, 95%, more preferably 99% identity with, or which is identical to, a fragment of the genomic sequence complementary to the genomic sequence of a bacterium of the *Salmonella* genus located in a region of 1000 by in a position 3' of the CRISPR2 locus, said fragment of the complementary genomic sequence being of the same size as said primer B2;

a set of primers "C" capable of amplifying a nucleic acid fragment comprising the CRISPR1 locus and the CRISPR2 locus, comprising at least one forward primer A1 as defined above and at least one reverse primer B2 as defined above;

(b) determining the variable-sequence composition of the CRISPR1 locus and/or of the CRISPR2 locus included in the nucleic acid fragments amplified in step (a); and (c) comparing said variable-sequence composition of the CRISPR1 and/or CRISPR2 loci with a reference base which provides the variable-sequence composition of the CRISPR1 and CRISPR2 loci of types and subtypes of bacteria of the *Salmonella* genus, listed in FIGS. 10 and 9, or a part of this base.

The term "molecular typing" is intended to mean determining the serotype (or serovar) of a bacterium of the *Salmonella* genus belonging to the two species and six subspecies as described above, by characterization of a part of its genome (i.e. the CRISPR1 and/or CRISPR2 loci).

The term "molecular subtyping" is intended to mean determining the subtype of a bacterial strain belonging to a given *Salmonella* serotype, by characterization of a part of its genome (i.e. the CRISPR1 and/or CRISPR2 loci). The identification of the subtype of a bacterial strain of *Salmonella* is important, for example, for recognizing the foci of infection, detecting a cross transmission of *Salmonella*, determining the source of the infection or recognizing more particularly the virulent strains of *Salmonella*.

The term "CRISPR locus" is intended to mean a genomic DNA sequence composed of a series of repeat nucleotide sequences (called DR) having a size of approximately 21 to 37 base pairs, spaced out by variable nucleotide sequences (spacers) having a size of approximately 20 to 40 base pairs. The bacteria of the *Salmonella* genus have one or two CRISPR loci. The following table 1 shows the location of the CRISPR1 and CRISPR2 loci of some strains of bacteria of the *Salmonella* genus:

| Strains and accession numbers in the GenBank database referencing the genome of the strains | Location of the CRISPR1 locus in the genome of the bacteria, with reference to the accession number in the GenBank database | Location of the CRISPR2 locus in the genome of the bacteria, with reference to the accession number in the GenBank database |
| --- | --- | --- |
| *S. enterica* subsp *enterica* serotype: | | |
| Typhimurium strain LT2 AE008834 (GI: 16421485) and AE008835 (GI: 16421501), of Aug. 9, 2005 | nucleotides 1183-2719 | nucleotides 18852 (AE008834)-863 (AE008835) |

| Strains and accession numbers in the GenBank database referencing the genome of the strains | Location of the CRISPR1 locus in the genome of the bacteria, with reference to the accession number in the GenBank database | Location of the CRISPR2 locus in the genome of the bacteria, with reference to the accession number in the GenBank database |
|---|---|---|
| Typhi strain CT18 AL627276 (of Nov. 14, 2006; GI: 16503805) | nucleotides 224182-224567 | nucleotides 241124-241212 |
| Typhi strain Ty2 AE014613 (of Jan. 17, 2006; GI: 29140506) | nucleotides 2912041-2912461 | nucleotides 2929018-2929106 |
| Paratyphi A strain ATCC 9150 CP000026 (of Apr. 8, 2005; GI: 56126533) | nucleotides 2889569-2889902 | nucleotides 2906454-2906664 |
| Paratyphi A strain AKU_12601 FM200053 (of Oct. 23, 2008; GI: 197092687) | nucleotides 2885105-2885559 | nucleotides 2902112-2902322 |
| Enteritidis strain P225109 AM933172 (of Oct. 23, 2008; GI: 206707319) | nucleotides 2961370-2961886 | nucleotides 2978039-2978677 |
| Gallinarum strain 287/91 AM933173 (of Oct. 8, 2008; GI: 205271127) | nucleotides 2952175-2952327 | nucleotides 2968479-2969117 |
| Dublin strain CT_02021853 CP001144 (of Sep. 5, 2008; GI: 197936256) | nucleotides 3121101-3121251 | nucleotides 3137410-33137742 |
| Choleraesuis strain SC-B67 AE017220 (of Jan. 11, 2006; GI: 62126203) | nucleotides 3031533-3031805 | nucleotides 3049245-3049698 |
| Newport strain SL254 CP001113 (of Jul. 25, 2008; GI: 194400866 | nucleotides 3054859-3056473 | nucleotides 3073143-3074328 |
| Agona strain SL483 CP001138 (of Aug. 22, 2008; GI: 197211055) | nucleotides 2988105 to 2989231 | nucleotides 3005518 to 006033 |
| Heidelberg strain SL476 CP001120 (of Jul. 25, 2008; GI: 194405610) | nucleotides 3051217-3052879 | nucleotides 3069138-3070263 |
| Schwarzengrund strain CVM19633 CP001127 (of Jul. 30, 2008; GI: 194709404) | nucleotides 2981949-2982709 | nucleotides 2999470-3000534 |
| Paratyphi B strain SPB7 CP000886 (of Jan. 15, 2008; GI: 161361677) | nucleotides 3041329-3041479 | nucleotides 3050805-3051137 |
| *S. enterica* subsp *arizonae* serotype: | | |
| 62:z4,z23:- strain CDC346-86 CP000880 (of Jan. 15, 2008; GI: 160863331) | nucleotides 25560-25471 | nucleotides 17801-1773 |

In the context of the disclosure of the present invention, the CRISPR1 locus is defined as being located in a position 5' with respect to the CRISPR2 locus.

Unless otherwise specified, the identity percentages indicated in the context of the disclosure of the present invention are calculated over a window of comparison constituted of the entire sequence of the primer as reference sequence. The percentage of identical nucleotides can be calculated by those skilled in the art using a sequence comparison computer program.

The reference base according to the present invention indicates the variable-sequence composition of the CRISPR1 and/or CRISPR2 loci of the 564 *Salmonella* strains analyzed by the inventors or of a part of these strains. Said reference base includes in particular the *Salmonella* strains of clinical and food-product interest currently known. Of course, the variable-sequence composition of new *Salmonella* bacterial strains can be added to said reference base.

Advantageously, the method according to the present invention makes it possible not only to obtain a genomic DNA fragment comprising the whole of one or of the two CRISPR loci of a bacterium of the *Salmonella* genus, so as to determine the variable-sequence composition of these loci in order to be able to compare it with said reference base and thus determine the molecular type and/or subtype of the bacterium, but also to identify new *Salmonella* strains by determining the variable-sequence composition of these CRISPR loci.

The identity of the variable-sequence composition determined in step (b) of the method according to the invention with respect to a composition appearing in said reference base is thus indicative of the type and/or subtype of the bacterium of the *Salmonella* genus present in the sample.

The expression "determining the variable-sequence composition of the CRISPR1 locus and/or of the CRISPR2 locus" is intended to mean determining the number, the nucleotide sequence and, optionally, the order of the spacers in the CRISPR1 and/or CRISPR2 locus of *Salmonella*.

In one particular embodiment, the bacteria of the *Salmonella* genus for which the molecular typing and/or subtyping method according to the invention is carried out are chosen from the group constituted of:

i) the species *S. enterica*
    subspecies *enterica*; in particular the serotypes Abony, Abortusequi, Aesch, Agona, Albany, Altona, Anatum, Arechavalata, Bardo, Berta, Bispebjerg, Blegdam, Bovismorbificans, Brandenburg, Chester, Choleraesuis variety Decatur, Choleraesuis, Choleraesuis variety Kunzendorf, Choleraesuis sensu stricto, Concord, Crossness, Derby, Dublin, Duesseldorf, Emek, Enteritidis, Fulica, Gallinarum variety Duisburg, Gallinarum variety Gallinarum, Gallinarum variety Pullorum, Goettingen, Gueuletapee, Hadar, Heidelberg, Hessarek, Indiana, Infantis, Itami, Javiana, Johannesburg, Kentucky, Kiel, Kottbus, Kundunchi, Lindenburg, Manhattan, Maracaibo, Mbandaka, Miami, Mississippi, Montevideo, Muenchen, Napoli, Newport, Niarembe, Nitra, Overvecht, Panama, Paratyphi A, Paratyphi B, Paratyphi C, Poona, Potsdam, Reading, Rosenberg, Rubislaw, Saintpaul, Sandiego, Schwarzengrund, Sendai, Senftenberg, Stourbridge, Tallahassee, Tennessee, Typhi, Typhimurium, Typhisuis, Urbana, Virchow, Weltevreden, Zaiman, subspecies *salamae*; in particular the serotypes 11:1,z28: e,n,x; 57:z42:1,6:Rz53;

subspecies *arizonae*; in particular the serotypes 62:z4, z23:–; 53:g,z51:–; 56:z4,z23:–; 17:z29:–;

subspecies *diarizonae*; in particular the serotypes 38:z10: z53; 61:1,v:1,5,7;

subspecies *houtenae*; in particular the serotypes 6,7:z4, z24:–; 44:a:–; 1,40:z4,z24:–;

subspecies *indica*; in particular the serotypes 11:b:1,7; 6,7: z41:1,7;

ii) the species bongori; in particular the serotypes 60:z41:–; 66:z35:–; 48:z35:–; 66:z41:–.

The terms "nucleic acid" and "DNA" are equivalent and comprise single-stranded or double-stranded nucleic acids.

According to one advantageous embodiment of the method in accordance with the invention, the nucleic acid fragment to be amplified in step (a) above has a size of between 400 and 20 000 bp.

According to one embodiment of the method in accordance with the present invention, said amplification can be carried out by any method known to those skilled in the art. Preferably, the amplification can be carried out by a method selected from the group consisting of: polymerase chain reaction (PCR), ligase chain reaction (LCR), nucleic acid sequence-based amplification (NASBA), cycling probe technology (CPT), nested PCR and multiplex PCR.

According to one advantageous embodiment of the method in accordance with the invention, said fragment of the genomic sequence of a bacterium of the *Salmonella* genus located in a position 5' of the CRISPR1 locus, and/or said fragment of the genomic sequence complementary to the genomic sequence of a bacterium of the *Salmonella* genus located in a position 3' of the CRISPR2 locus, is(are) located at a distance from the CRISPR1 or CRISPR2 locus of less than 500 bp, preferably less than 100 bp.

The term "primer" denotes a single-stranded or double-stranded oligonucleotide, preferably a single-stranded oligonucleotide for optimal efficiency. A primer (an oligonucleotide primer), once hybridized to a single-stranded nucleic acid sequence, termed "template", is a substrate for at least one DNA polymerase (i.e. a primer hybridized to a nucleic acid sequence has the property of binding, at its 3'OH end, at least one DNA polymerase). In the presence of appropriate nucleotides (A, C, G, T), of a DNA polymerase (for example, the Taq polymerase), of an appropriate buffer (comprising cofactors or compounds affecting the pH or the ionic strength of the reaction medium, for example) and at an appropriate temperature, the 3'OH end of a primer can be extended, thus resulting in the synthesis of a strand complementary to the template sequence to which said primer is hybridized. The primers, according to the present invention, preferably have a length of less than or equal to 50 nucleotides, i.e. less than or equal to 40, 30, 20, 15 or 10 nucleotides. More preferably, the primers according to the present invention have a length of between 15 and 30 nucleotides, preferably between 18 and 25 nucleotides. The primers according to the present invention can be advantageously labeled.

For the purpose of the present invention, two nucleic acid molecules are "complementary" when each of the bases in successive positions of the 5' end of the first nucleic acid molecule is paired with the corresponding residue in the second molecule, starting from the 3' end, according to the rules of base-pair pairing (i.e. A and T, C and G). Under suitable conditions known to those skilled in the art, two complementary single strands of DNA reassociate to form a double-stranded DNA molecule.

According to one particular embodiment, the set of primers for amplifying the nucleic acid fragment comprising the CRISPR1 locus and/or the CRISPR2 locus is selected from the group constituted of:

the set of primers, capable of amplifying the CRISPR1 locus, constituted of the primer of sequence SEQ ID No.: 1326 (SALCRISP1-FB) combined with at least one of the primers of sequence SEQ ID Nos: 1327 (SALCRISP1-RB), 1328 (AriParaB-R), 1329 (BrPanCR1-R), 2151 (50K) and 2152 (HoutWS24R), the set of primers, capable of amplifying the CRISPR2 locus, constituted of the primer of sequence SEQ ID No.: 1330 (SALCRISP2-FB), combined with at least one of the primers of sequence SEQ ID Nos: 1331 (SALCRISP2-RA) and 1332 (SALCRISP2-RB), and the set of primers, capable of simultaneously amplifying the two loci CRISPR1 and CRISPR2, constituted of the primer of sequence SEQ ID No.: 1326, combined with at least one of the two primers of sequences 1331 and 1332 (the primers of sequence SEQ ID Nos: 1326 and 1331 being located at least 100 by from the CRISPR1 and CRISPR2 loci respectively, and the primer of sequence SEQ ID No.: 1332 being located at least 500 by from the CRISPR2 locus).

Consequently, the subject of the present invention is also a set of primers, as defined above, capable of amplifying a fragment of the genomic sequence of a bacterium of the *Salmonella* genus.

In one particular embodiment according to the invention, the forward primer A 1 is constituted of an oligonucleotide sequence which exhibits at least 70%, preferably 80%, 85%, 95%, more preferably 99% identity with, or which is identical to, a fragment of the genomic sequence of *S. enterica* serotype Typhimurium LT2 or of *S. enterica* serotype Typhi CT18, located in a region of 1000 by in a position 5' of the CRISPR1 locus (for example, for the LT2 strain, the region corresponding to nucleotides 183 to 1183 of the genomic sequence available under number AE008834 (GI: 16421485)), said fragment of the genomic sequence located in a position 5' of the CRISPR1 locus being of the same size as said primer A1.

In one particular embodiment according to the invention, the reverse primer A2 is constituted of an oligonucleotide sequence which exhibits 70%, preferably 80%, 85%, 95%, more preferably 99% identity with, or which is identical to, a fragment of the genomic sequence complementary to the genomic sequence of *S. enterica* serotype Typhimurium LT2 or of *S. enterica* serotype Typhi CT18, which is located in a position 3' of the CRISPR1 locus and in a position 5' of the CRISPR2 locus (for example, for the LT2 strain, the region corresponding to nucleotides 2727 to 18836, preferably 2727 to 3727, of the genomic sequence available under number AE008834 (GI: 16421485)), said fragment being of the same size as said primer A2.

In one particular embodiment according to the invention, the forward primer B1 is constituted of an oligonucleotide sequence which exhibits at least 70%, preferably 80%, 85%, 95%, more preferably 99% identity with, or which is identical to, a fragment of the genomic sequence of *S. enterica* serotype Typhimurium LT2 or of *S. enterica* serotype Typhi CT18, which is located in a position 3' of the CRISPR1 locus and in a position 5' of the CRISPR2 locus (for example, for the LT2 strain, the region corresponding to nucleotides 2727 to 18836, preferably 17836 to 18836, of the genomic sequence available under number AE008834 (GI: 16421485)), said fragment of the genomic sequence located in a position 3' of the CRISPR1 locus and in a position 5' of the CRISPR2 locus being of the same size as said primer.

In one particular embodiment according to the invention, the reverse primer B2 is constituted of an oligonucleotide sequence which has at least 70%, preferably 80%, 85%, 95%, more preferably 99% identity with, or which is identical to, a fragment of the genomic sequence complementary to the genomic sequence of *S. enterica* serotype Typhimurium LT2 or of *S. enterica* serotype Typhi CT18, which is located in a region of 1000 by in a position 3' of the CRISPR2 locus (for example, for the LT2 strain, the region corresponding to nucleotides 862 to 1862 of the genomic sequence available under number AE008835 (GI: 16421501)), said complementary genomic sequence fragment being of the same size as said primer.

According to one advantageous embodiment of the method in accordance with the invention, step (b) described above is carried out by means of a DNA sequencing method. By way of example, the sequencing can be carried out by the Sanger method or the Maxam and Gilbert method, which are methods well known to those skilled in the art.

According to one advantageous embodiment of the method in accordance with the invention, step (b) described above is carried out by:

(i) hybridization of the amplification products with one, several or all the set(s) of probes, chosen from:

set S1-1, comprising or constituted of at least one probe comprising at least or constituted of at least 8 consecutive nucleotides of any one of the nucleic acid sequences SEQ ID Nos.: 1106 to 1119, 1123 to 1140, 1142, 1143, 1914 and/or the nucleic acid sequences complementary thereto (nucleotide sequences corresponding to the various variable sequences of the CRISPR1 locus of the serotype Typhimurium);

set S1-2, comprising or constituted of at least one probe comprising at least or constituted of at least 8 consecutive nucleotides of any one of the nucleic acid sequences SEQ ID Nos.: 455, 1144 to 1153, 1155 to 1181 and/or the nucleic acid sequences complementary thereto (nucleotide sequences corresponding to the various variable sequences of the CRISPR2 locus of the serotype Typhimurium);

set S2-1, comprising or constituted of at least one probe comprising at least or constituted of at least 8 consecutive nucleotides of any one of the nucleic acid sequences SEQ ID Nos.: 256, 378 to 381, 383 to 387, 389 to 391, 1106, 1514, 1528, 2148 to 2153 and/or the nucleic acid sequences complementary thereto (nucleotide sequences corresponding to the various variable sequences of the CRISPR1 locus of the serotype Enteritidis);

set S2-2, comprising or constituted of at least one probe comprising at least or constituted of at least 8 consecutive nucleotides of any one of the nucleic acid sequences SEQ ID Nos.: 392 to 413, 519, 815, 972, 983, 989, 1529 to 1546, 1952 and/or the nucleic acid sequences complementary thereto (nucleotide sequences corresponding to the various variable sequences of the CRISPR2 locus of the serotype Enteritidis);

set S3-1, comprising or constituted of at least one probe comprising at least or constituted of at least 8 consecutive nucleotides of any one of the nucleic acid sequences SEQ ID Nos.: 421 to 442, 444, 445, 447 to 450 and/or the nucleic acid sequences complementary thereto (nucleotide sequences corresponding to the various variable sequences of the CRISPR1 locus of the serotype Hadar);

set S3-2, comprising or constituted of at least one probe comprising at least or constituted of at least 8 consecutive nucleotides of any one of the nucleic acid sequences SEQ ID Nos.: 451 to 465, 1144 to 1147, 1150 to 1152, 1154, 1155, 1158, 1169, 1172, 1175 to 1177, 1179, 1181 and/or the nucleic acid sequences complementary thereto (nucleotide sequences corresponding to the various variable sequences of the CRISPR2 locus of the serotype Hadar);

set S4-1, comprising or constituted of at least one probe comprising at least or constituted of at least 8 consecutive nucleotides of any one of the nucleic acid sequences SEQ ID Nos.: 65, 382, 1120, 1263 to 1302, 2024 to 2038 and/or the nucleic acid sequences complementary thereto (nucleotide sequences corresponding to the various variable sequences of the CRISPR1 locus of the serotype Virchow);

set S4-2, comprising or constituted of at least one probe comprising at least or constituted of at least 8 consecutive nucleotides of any one of the nucleic acid sequences SEQ ID Nos.: 83, 93, 94, 1304 to 1324 and/or the nucleic acid sequences complementary thereto (nucleotide sequences corresponding to the various variable sequences of the CRISPR2 locus of the serotype Virchow);

set S5-1, comprising or constituted of at least one probe comprising at least or constituted of at least 8 consecutive nucleotides of any one of the nucleic acid sequences SEQ ID Nos.: 531 to 562, 1106 and/or the nucleic acid sequences complementary thereto (nucleotide sequences corresponding to the various variable sequences of the CRISPR1 locus of the serotype Infantis);

set S5-2, comprising or constituted of at least one probe comprising at least or constituted of at least 8 consecutive nucleotides of any one of the nucleic acid sequences SEQ ID Nos.: 563 to 588 and/or the nucleic acid sequences complementary thereto (nucleotide sequences corresponding to the various variable sequences of the CRISPR2 locus of the serotype Infantis);

set S6-1, comprising or constituted of at least one probe comprising at least or constituted of at least 8 consecutive nucleotides of any one of the nucleic acid sequences SEQ ID Nos.: 1254 to 1259 and/or the nucleic acid sequences complementary thereto (nucleotide sequences corresponding to the various variable sequences of the CRISPR1 locus of the serotype Typhi);

set S6-2, comprising or constituted of at least one probe comprising at least or constituted of at least 8 consecutive nucleotides of the nucleic acid sequence SEQ ID No.: 1260 and/or the nucleic acid sequence complementary thereto (nucleotide sequences corresponding to the variable sequence of the CRISPR2 locus of the serotype Typhi);

set S7-1, comprising or constituted of at least one probe comprising at least or constituted of at least 8 consecutive nucleotides of any one of the nucleic acid sequences SEQ ID Nos: 448, 449, 860 to 884, 1719 to 1724, 1727 to 1743, 1745 and/or the nucleic acid sequences complementary thereto (nucleotide sequences corresponding to the various variable sequences of the CRISPR1 locus of the serotype Newport);

set S7-2, comprising or constituted of at least one probe comprising at least or constituted of at least 8 consecutive nucleotides of any one of the nucleic acid sequences SEQ ID Nos: 453 to 456, 563, 621, 622, 625, 626, 657, 885 to 896, 906 to 915, 933, 1144, 1145, 1155, 1156, 1172, 1174, 1748 to 1756, 1758, 1759, 1916 and/or the nucleic acid sequences complementary thereto (nucleotide sequences corresponding to the various variable sequences of the CRISPR2 locus of the serotype Newport);

set S8-1, comprising or constituted of at least one probe comprising at least or constituted of at least 8 consecutive nucleotides of any one of the nucleic acid sequences SEQ ID Nos: 295 to 299, 301 to 323, 738, 1106 to 1109, 1120, 1123, 1128 to 1131, 1133, 1137 to 1140, 1550, 1159 to 1561 and/or the nucleic acid sequences complementary thereto (nucleotide sequences corresponding to the various variable sequences of the CRISPR1 locus of the serotype Derby);

set S8-2, comprising or constituted of at least one probe comprising at least or constituted of at least 8 consecutive nucleotides of any one of the nucleic acid sequences SEQ ID Nos: 324 to 337, 455, 1144, 1145, 1149 to 1153, 1155 to 1160, 1163, 1172 to 1174 and/or the nucleic acid sequences complementary thereto (nucleotide sequences corresponding to the various variable sequences of the CRISPR2 locus of the serotype Derby);

set S9-1, comprising or constituted of at least one probe comprising at least or constituted of at least 8 consecutive nucleotides of any one of the nucleic acid sequences SEQ ID Nos: 295, 307, 602 to 614, 616 to 619, 1106, 1120 and/or the nucleic acid sequences complementary thereto (nucleotide sequences corresponding to the various variable sequences of the CRISPR1 locus of the serotype Kottbus);

set S9-2, comprising or constituted of at least one probe comprising at least or constituted of at least 8 consecutive nucleotides of any one of the nucleic acid sequences SEQ ID Nos: 563, 620 to 629, 885, 896, 907, 913, 914, 933 and/or the nucleic acid sequences complementary thereto (nucleotide sequences corresponding to the various variable sequences of the CRISPR2 locus of the serotype Kottbus);

set S10-1, comprising or constituted of at least one probe comprising at least or constituted of at least 8 consecutive nucleotides of any one of the nucleic acid sequences SEQ ID Nos: 422 to 425, 448 to 450, 504 to 518 and/or the nucleic acid sequences complementary thereto (nucleotide sequences corresponding to the various variable sequences of the CRISPR1 locus of the serotype Indiana);

set S10-2, comprising or constituted of at least one probe comprising at least or constituted of at least 8 consecutive nucleotides of any one of the nucleic acid sequences SEQ ID Nos: 246, 258, 269, 392, 415, 519 to 530 and/or the nucleic acid sequences complementary thereto (nucleotide sequences corresponding to the various variable sequences of the CRISPR2 locus of the serotype Indiana);

set S11-1, comprising or constituted of at least one probe comprising at least or constituted of at least 8 consecutive nucleotides of any one of the nucleic acid sequences SEQ ID Nos: 11 to 23, 238, 948, 1120, 1123, 1133 and/or the nucleic acid sequences complementary thereto (nucleotide sequences corresponding to the various variable sequences of the CRISPR1 locus of the serotype Agona);

set S11-2, comprising or constituted of at least one probe comprising at least or constituted of at least 8 consecutive nucleotides of any one of the nucleic acid sequences SEQ ID Nos: 24 to 31 and/or the nucleic acid sequences complementary thereto (nucleotide sequences corresponding to the various variable sequences of the CRISPR2 locus of the serotype Agona);

set S12-1, comprising or constituted of at least one probe comprising at least or constituted of at least 8 consecutive nucleotides of any one of the nucleic acid sequences SEQ ID Nos: 830 to 841, 1120 and/or the nucleic acid sequences complementary thereto (nucleotide sequences corresponding to the various variable sequences of the CRISPR1 locus of the serotype Napoli);

set S12-2, comprising or constituted of at least one probe comprising at least or constituted of at least 8 consecutive nucleotides of any one of the nucleic acid sequences SEQ ID Nos: 842 to 859 and/or the nucleic acid sequences complementary thereto (nucleotide sequences corresponding to the various variable sequences of the CRISPR2 locus of the serotype Napoli);

set S13-1, comprising or constituted of at least one probe comprising at least or constituted of at least 8 consecutive nucleotides of any one of the nucleic acid sequences SEQ ID Nos: 926 to 932 and/or the nucleic acid sequences complementary thereto (nucleotide sequences corresponding to the various variable sequences of the CRISPR1 locus of the serotype Paratyphi A);

set S13-2, comprising or constituted of at least one probe comprising at least or constituted of at least 8 consecutive nucleotides of any one of the nucleic acid sequences SEQ ID Nos: 933, 935, 936 and/or the nucleic acid sequences complementary thereto (nucleotide sequences corresponding to the various variable sequences of the CRISPR2 locus of the serotype Paratyphi A);

set S14-1, comprising or constituted of at least one probe comprising at least or constituted of at least 8 consecutive nucleotides of any one of the nucleic acid sequences SEQ ID Nos: 707, 937 to 971, 1106, 1128 to 1130, 1133, 1138, 1140, 1802 to 1808, 1915 and/or the nucleic acid sequences complementary thereto (nucleotide sequences corresponding to the various variable sequences of the CRISPR1 locus of the serotypes Paratyphi B and Paratyphi B Java);

set S14-2, comprising or constituted of at least one probe comprising at least or constituted of at least 8 consecutive nucleotides of any one of the nucleic acid sequences SEQ ID Nos: 861, 972 to 987, 989 to 992 996, 1172, 1262, 1462, 1497, 1810 to 1825 and/or the nucleic acid sequences complementary thereto (nucleotide sequences corresponding to the various variable sequences of the CRISPR2 locus of the serotypes Paratyphi B and Paratyphi B Java);

set S15-1, comprising or constituted of at least one probe comprising at least or constituted of at least 8 consecutive nucleotides of any one of the nucleic acid sequences SEQ ID Nos: 232, 238, 239, 997 to 1002, 1106 and/or the nucleic acid sequences complementary thereto (nucleotide sequences corresponding to the various variable sequences of the CRISPR1 locus of the serotype Paratyphi C);

set S15-2, comprising or constituted of at least one probe comprising at least or constituted of at least 8 consecutive nucleotides of any one of the nucleic acid sequences SEQ ID Nos: 280, 290, 291, 392, 393, 415, 1003 to 1006, 1262 and/or the nucleic acid sequences complementary thereto (nucleotide sequences corresponding to the various variable sequences of the CRISPR2 locus of the serotype Paratyphi C);

set S16-1, comprising or constituted of at least one probe comprising at least or constituted of at least 8 consecutive nucleotides of any one of the nucleic acid sequences SEQ ID Nos: 211 to 224, 421, 427, 428, 432, 443 to 445, 447 to 449, 504 and/or the nucleic acid sequences complementary thereto (nucleotide sequences corresponding to the various variable sequences of the CRISPR1 locus of the serotype Bovismorbificans);

set S16-2, comprising or constituted of at least one probe comprising at least or constituted of at least 8 consecutive nucleotides of any one of the nucleic acid sequences SEQ ID Nos: 196 to 209, 994, 1144, 1145, 1172 and/or the nucleic acid sequences complementary thereto (nucleotide sequences corresponding to the various variable sequences of the CRISPR2 locus of the serotype Bovismorbificans);

set S17-1, comprising or constituted of at least one probe comprising at least or constituted of at least 8 consecutive nucleotides of the nucleic acid sequence SEQ ID No.: 916 and/or the nucleic acid sequence complementary thereto (nucleotide sequences corresponding to the variable sequences of the CRISPR1 locus of the serotype Panama);

set S17-2, comprising or constituted of at least one probe comprising at least or constituted of at least 8 consecutive nucleotides of any one of the nucleotide sequences SEQ ID Nos: 918 to 925, 934 and/or the nucleic acid sequences complementary thereto (nucleotide sequences corresponding to the various variable sequences of the CRISPR2 locus of the serotype Panama);

set S18-1, comprising or constituted of at least one probe comprising at least or constituted of at least 8 consecutive nucleotides of any one of the nucleotide sequences SEQ ID Nos: 11, 16, 67, 74, 442, 444, 446 to 448, 602, 937, 948, 1120, 1128 to 1130, 1182 to 1200, 1937 to 1950, and/or the nucleic acid sequences complementary thereto (nucleotide sequences corresponding to the various variable sequences of the CRISPR1 locus of the serotype Saintpaul);

set S18-2, comprising or constituted of at least one probe comprising at least or constituted of at least 8 consecutive nucleotides of any one of the nucleotide sequences SEQ ID Nos: 972, 983, 989, 1201 to 1214, 1216 to 1227, 1952 to 1960 and/or the nucleic acid sequences complementary thereto (nucleotide sequences corresponding to the various variable sequences of the CRISPR2 locus of the serotype Saintpaul);

set S19-1, comprising or constituted of at least one probe comprising at least or constituted of at least 8 consecutive nucleotides of any one of the nucleotide sequences SEQ ID Nos: 514, 1062 to 1089, 1100, 1284, 1886 to 1911 and/or the nucleic acid sequences complementary thereto (nucleotide sequences corresponding to the various variable sequences of the CRISPR1 locus of the serotype Senftenberg);

set S19-2, comprising or constituted of at least one probe comprising at least or constituted of at least 8 consecutive nucleotides of any one of the nucleotide sequences SEQ ID Nos: 300, 1090 to 1097, 1101 to 1103, 1304, 1315, 1318 to 1320 and/or the nucleic acid sequences complementary thereto (nucleotide sequences corresponding to the various variable sequences of the CRISPR2 locus of the serotype Senftenberg);

set S20-1, comprising or constituted of at least one probe comprising at least or constituted of at least 8 consecutive nucleotides of any one of the nucleotide sequences SEQ ID Nos: 67, 74 to 80 and/or the nucleic acid sequences complementary thereto (nucleotide sequences corresponding to the various variable sequences of the CRISPR1 locus of the serotype Anatum);

set S20-2, comprising or constituted of at least one probe comprising at least or constituted of at least 8 consecutive nucleotides of any one of the nucleotide sequences SEQ ID Nos: 83 to 94, 1304, 1315, 1318 to 1322, 1324, 1390 to 1397 and/or the nucleic acid sequences complementary thereto (nucleotide sequences corresponding to the various variable sequences of the CRISPR2 locus of the serotype Anatum);

set S21-1, comprising or constituted of at least one probe comprising at least or constituted of at least 8 consecutive nucleotides of any one of the nucleotide sequences SEQ ID Nos: 379, 383 to 385, 388 and/or the nucleic acid sequences complementary thereto (nucleotide sequences corresponding to the various variable sequences of the CRISPR1 locus of the serotypes Gallinarum);

set S21-2, comprising or constituted of at least one probe comprising at least or constituted of at least 8 consecutive nucleotides of any one of the nucleotide sequences SEQ ID Nos: 392, 393, 404, 407 to 415 and/or the nucleic acid sequences complementary thereto (nucleotide sequences corresponding to the various variable sequences of the CRISPR2 locus of the serotypes Gallinarum);

set S22-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Brandenburg);

set S22-2, comprising or constituted of at least one probe comprising at least or constituted of at least 8 consecutive nucleotides of any one of the nucleic acid sequences SEQ ID Nos: 225 to 231 and/or the nucleic acid sequences complementary thereto (nucleotide sequences corresponding to the various variable sequences of the CRISPR2 locus of the serotype Brandenburg);

set S23-1, comprising or constituted of at least one probe comprising at least or constituted of at least 8 consecutive nucleotides of any one of the nucleic acid sequences SEQ ID Nos: 378, 379 and/or the nucleic acid sequences complementary thereto (nucleotide sequences corresponding to the various variable sequences of the CRISPR1 locus of the serotype Dublin);

set S23-2, comprising or constituted of at least one probe comprising at least or constituted of at least 8 consecutive nucleotides of any one of the nucleic acid sequences SEQ ID Nos: 392, 393, 411, 412 and/or the nucleic acid sequences complementary thereto (nucleotide sequences corresponding to the various variable sequences of the CRISPR2 locus of the serotype Dublin);

set S24-1, comprising or constituted of at least one probe comprising at least or constituted of at least 8 consecutive nucleotides of any one of the nucleic acid sequences SEQ ID Nos: 1, 1106 and/or the nucleic acid sequences complementary thereto (nucleotide sequences corresponding to the various variable sequences of the CRISPR1 locus of the serotype Abortusequi);

set S24-2, comprising or constituted of at least one probe comprising at least or constituted of at least 8 consecutive nucleotides of any one of the nucleic acid sequences SEQ ID Nos: 2 to 10, 130 and/or the nucleic acid sequences complementary thereto (nucleotide sequences corresponding to the various variable sequences of the CRISPR2 locus of the serotype Abortusequi);

set S25-1, comprising or constituted of at least one probe comprising at least or constituted of at least 8 consecutive nucleotides of any one of the nucleic acid sequences SEQ ID Nos: 378, 379 and/or the nucleic acid sequences complementary thereto (nucleotide sequences corresponding to the various variable sequences of the CRISPR1 locus of the serotype Kiel);

set S25-2, comprising or constituted of at least one probe comprising at least or constituted of at least 8 consecutive nucleotides of any one of the nucleic acid sequences SEQ ID Nos: 392, 393, 411, 412 and/or the nucleic acid sequences complementary thereto (nucleotide sequences corresponding to the various variable sequences of the CRISPR2 locus of the serotype Kiel);

set S26-1, comprising or constituted of at least one probe comprising at least or constituted of at least 8 consecutive nucleotides of any one of the nucleic acid sequences SEQ ID Nos: 509, 510, 512, 513, 637 to 660, 1086, 1107 and/or the nucleic acid sequences complementary thereto (nucleotide sequences corresponding to the various variable sequences of the CRISPR1 locus of the serotype Mbandaka);

set S26-2, comprising or constituted of at least one probe comprising at least or constituted of at least 8 consecutive nucleotides of any one of the nucleic acid sequences SEQ ID Nos: 661 to 666, 668, 669, 672, 683, 690 to 695, 731, 918 and/or the nucleic acid sequences complementary thereto (nucleotide sequences corresponding to the various variable sequences of the CRISPR2 locus of the serotype Mbandaka);

set S27-1, comprising or constituted of at least one probe comprising at least or constituted of at least 8 consecutive nucleotides of any one of the nucleic acid sequences SEQ ID No.: 916 and/or the nucleic acid sequence complementary thereto (nucleotide sequences corresponding to the various variable sequences of the CRISPR1 locus of the serotype Miami);

set S27-2, comprising or constituted of at least one probe comprising at least or constituted of at least 8 consecutive nucleotides of any one of the nucleic acid sequences SEQ ID Nos: 25, 696 to 700 and/or the nucleic acid sequences complementary thereto (nucleotide sequences corresponding to the various variable sequences of the CRISPR2 locus of the serotype Miami);

set S28-1, comprising or constituted of at least one probe comprising at least or constituted of at least 8 consecutive nucleotides of any one of the nucleic acid sequences SEQ ID Nos: 55, 701 to 730, 732 to 768, 1115, 1228, 1232 to 1237, 1601, 1671 to 1680, 1682 to 1694, 1747 and/or the nucleic acid sequences complementary thereto (nucleotide sequences corresponding to the various variable sequences of the CRISPR1 locus of the serotype Montevideo);

set S28-2, comprising or constituted of at least one probe comprising at least or constituted of at least 8 consecutive nucleotides of any one of the nucleic acid sequences SEQ ID Nos: 589, 769 to 829, 933, 1245, 1697, 1698 and/or the nucleic acid sequences complementary thereto (nucleotide sequences corresponding to the various variable sequences of the CRISPR2 locus of the serotype Montevideo);

set S29-1, comprising or constituted of at least one probe comprising at least or constituted of at least 8 consecutive nucleotides of any one of the nucleic acid sequences SEQ ID Nos: 379, 380, 383 to 385, 387, 389 to 391 and/or the nucleic acid sequences complementary thereto (nucleotide sequences corresponding to the various variable sequences of the CRISPR1 locus of the serotype Nitra);

set S29-2, comprising or constituted of at least one probe comprising at least or constituted of at least 8 consecutive nucleotides of any one of the nucleic acid sequences SEQ ID Nos: 392 to 394, 404, 407 to 413, 519 and/or the nucleic acid sequences complementary thereto (nucleotide sequences corresponding to the various variable sequences of the CRISPR2 locus of the serotype Nitra);

set S30-1, comprising or constituted of at least one probe comprising at least or constituted of at least 8 consecutive nucleotides of any one of the nucleic acid sequences SEQ ID Nos: 931, 932, 1104, 1105 and/or the nucleic acid sequences complementary thereto (nucleotide sequences corresponding to the various variable sequences of the CRISPR1 locus of the serotype Sendai);

set S30-2, comprising or constituted of at least one probe comprising at least or constituted of at least 8 consecutive nucleotides of the nucleic acid sequence SEQ ID No.: 936 and/or the nucleic acid sequence complementary thereto (nucleotide sequences corresponding to the variable sequence of the CRISPR2 locus of the serotype Sendai);

set S31-1, comprising or constituted of at least one probe comprising at least or constituted of at least 8 consecutive nucleotides of any one of the nucleic acid sequences SEQ ID Nos: 714 to 716, 1228 to 1239 and/or the nucleic acid sequences complementary thereto (nucleotide sequences corresponding to the various variable sequences of the CRISPR1 locus of the serotype Schwarzengrund);

set S31-2, comprising or constituted of at least one probe comprising at least or constituted of at least 8 consecutive nucleotides of any one of the nucleic acid sequences SEQ ID Nos: 196, 992, 995, 1172, 1240 to 1244, 1246 to 1253 and/or the nucleic acid sequences complementary thereto (nucleotide sequences corresponding to the various variable sequences of the CRISPR2 locus of the serotype Schwarzengrund);

set S32-1, comprising or constituted of at least one probe comprising at least or constituted of at least 8 consecutive nucleotides of any one of the nucleic acid sequences SEQ ID Nos: 232, 238, 239, 998, 999, 1002, 1106, 1261 and/or the nucleic acid sequences complementary thereto (nucleotide sequences corresponding to the various variable sequences of the CRISPR1 locus of the serotype Typhisuis);

set S32-2, comprising or constituted of at least one probe comprising at least or constituted of at least 8 consecutive nucleotides of the nucleic acid sequence SEQ ID No.: 1262 and/or the nucleic acid sequence complementary thereto (nucleotide sequences corresponding to the variable sequence of the CRISPR2 locus of the serotype Typhisuis);

set S33-1, comprising or constituted of at least one probe comprising at least or constituted of at least 8 consecutive nucleotides of any one of the nucleic acid sequences SEQ ID Nos: 466 to 486 and/or the nucleic acid sequences complementary thereto (nucleotide sequences corresponding to the various variable sequences of the CRISPR1 locus of the various serotypes of the *houtenae* subspecies);

set S33-2, comprising or constituted of at least one probe comprising at least or constituted of at least 8 consecutive nucleotides of any one of the nucleic acid sequences SEQ ID Nos: 487 to 490 and/or the nucleic acid sequences complementary thereto (nucleotide sequences corresponding to the various variable sequences of the CRISPR2 locus of the various serotypes of the *houtenae* subspecies);

set S34-1, comprising or constituted of at least one probe comprising at least or constituted of at least 8 consecutive nucleotides of any one of the nucleic acid sequences SEQ ID Nos: 338 to 376 and/or the nucleic acid sequences complementary thereto (nucleotide sequences corresponding to the various variable sequences of the CRISPR1 locus of the various serotypes of the *diarizonae* subspecies);

set S34-2, comprising or constituted of at least one probe comprising at least or constituted of at least 8 consecutive nucleotides of the nucleic acid sequence SEQ ID No.: 377 and/or the nucleic acid sequence complementary thereto (nucleotide sequences corresponding to the variable sequence of the CRISPR2 locus of the various serotypes of the *diarizonae* subspecies);

set S35-1, comprising or constituted of at least one probe comprising at least or constituted of at least 8 consecutive nucleotides of any one of the nucleic acid sequences SEQ ID Nos: 1007 to 1037, 1848 to 1884 and/or the nucleic acid sequences complementary thereto (nucleotide sequences corresponding to the various variable sequences of the CRISPR1 locus of the *salamae* subspecies);

set S35-2, comprising or constituted of at least one probe comprising at least or constituted of at least 8 consecutive nucleotides of any one of the nucleic acid sequences SEQ ID Nos: 1038 to 1061, 1885 and/or the nucleic acid sequences complementary thereto (nucleotide sequences corresponding to the various variable sequences of the CRISPR2 locus of the *salamae* subspecies);

set S36, comprising or constituted of at least one probe comprising at least or constituted of at least 8 consecutive nucleotides of the nucleic acid sequence SEQ ID No.: 95 and/or the nucleic acid sequence complementary thereto (nucleotide sequences corresponding to the variable sequence of the CRISPR1 locus of the various serotypes of the *arizonae* subspecies);

set S37-1, comprising or constituted of at least one probe comprising at least or constituted of at least 8 consecutive nucleotides of any one of the nucleic acid sequences SEQ ID Nos: 491 to 499 and/or the nucleic acid sequences complementary thereto (nucleotide sequences corresponding to the various variable sequences of the CRISPR1 locus of the various serotypes of the *indica* subspecies);

set S37-2, comprising or constituted of at least one probe comprising at least or constituted of at least 8 consecutive nucleotides of any one of the nucleic acid sequences SEQ ID Nos: 500 to 503, 1574 to 1589 and/or the nucleic acid sequences complementary thereto (nucleotide sequences corresponding to the various variable sequences of the CRISPR2 locus of the various serotypes of the *indica* subspecies);

set S38-1, comprising or constituted of at least one probe comprising at least or constituted of at least 8 consecutive nucleotides of any one of the nucleic acid sequences SEQ ID Nos: 32 to 66, 382, 416, 667, 2036 and/or the nucleic acid sequences complementary thereto (nucleotide sequences corresponding to the various variable sequences of the CRISPR1 locus of the serotype Altona);

set S38-2, comprising or constituted of at least one probe comprising at least or constituted of at least 8 consecutive nucleotides of any one of the nucleic acid sequences SEQ ID Nos: 854, 933, 1095, 1306, 1354 to 1389, 1696 and/or the nucleic acid sequences complementary thereto (nucleotide sequences corresponding to the various variable sequences of the CRISPR2 locus of the serotype Altona);

set S39-1, comprising or constituted of at least one probe comprising at least or constituted of at least 8 consecutive nucleotides of any one of the nucleic acid sequences SEQ ID Nos: 240, 241, 1120, 1121 and/or the nucleic acid sequences complementary thereto (nucleotide sequences corresponding to the various variable sequences of the CRISPR1 locus of the serotype Choleraesuis variety Decatur);

set S39-2, comprising or constituted of at least one probe comprising at least or constituted of at least 8 consecutive nucleotides of any one of the nucleic acid sequences SEQ ID Nos: 225, 247 to 251, 253 to 256, 259 to 268, 270 to 279, 281 to 289, 292 to 294 and/or the nucleic acid sequences complementary thereto (nucleotide sequences corresponding to the various variable sequences of the CRISPR2 locus of the serotype Choleraesuis variety Decatur);

set S40-1, comprising or constituted of at least one probe comprising at least or constituted of at least 8 consecutive nucleotides of any one of the nucleic acid sequences SEQ ID Nos: 11, 232, 238, 239, 240, 242 to 245, 233 to 237, 959, 1106, 1120 and/or the nucleic acid sequences complementary thereto (nucleotide sequences corresponding to the various variable sequences of the CRISPR1 locus of the serotype Choleraesuis variety Kunzendorf);

set S40-2, comprising or constituted of at least one probe comprising at least or constituted of at least 8 consecutive nucleotides of any one of the nucleic acid sequences SEQ ID Nos: 246, 252, 258, 269, 280, 290, 291, 392, 563, 933 and/or the nucleic acid sequences complementary thereto (nucleotide sequences corresponding to the various variable sequences of the CRISPR2 locus of the serotype Choleraesuis variety Kunzendorf);

set S41-1, comprising or constituted of at least one probe comprising at least or constituted of at least 8 consecutive nucleotides of any one of the nucleic acid sequences SEQ ID Nos: 11, 242 to 245, 232 to 239, 959, 1000, 1106, 1139, 1120 and/or the nucleic acid sequences complementary thereto (nucleotide sequences corresponding to the various variable sequences of the CRISPR1 locus of the serotypes Choleraesuis and Choleraesuis sensu stricto);

set S41-2, comprising or constituted of at least one probe comprising at least or constituted of at least 8 consecutive nucleotides of any one of the nucleic acid sequences SEQ ID Nos: 246, 252, 258, 269, 280, 290, 291, 392, 563, 574, 933, 1003, 1004 and/or the nucleic acid sequences complementary thereto (nucleotide sequences corresponding to the various variable sequences of the CRISPR2 locus of the serotypes Choleraesuis and Choleraesuis sensu stricto);

set S42-1, comprising or constituted of at least one probe comprising at least or constituted of at least 8 consecutive nucleotides of any one of the nucleic acid sequences SEQ ID Nos: 416 to 420, 1122 and/or the nucleic acid sequences complementary thereto (nucleotide sequences corresponding to the various variable sequences of the CRISPR1 locus of the serotype Goettingen);

set S42-2, comprising or constituted of at least one probe comprising at least or constituted of at least 8 consecutive nucleotides of the nucleic acid sequence SEQ ID No.: 1548 and/or the nucleic acid sequence complementary thereto (nucleotide sequences corresponding to the variable sequence of the CRISPR2 locus of the serotype Goettingen);

set S43-1, comprising or constituted of at least one probe comprising at least or constituted of at least 8 consecutive nucleotides of any one of the nucleic acid sequences SEQ ID Nos: 630 to 636, 937, 948, 1120, 1143 and/or the nucleic acid sequences complementary thereto (nucleotide sequences corresponding to the various variable sequences of the CRISPR1 locus of the serotype Manhattan);

set S43-2, comprising or constituted of at least one probe comprising at least or constituted of at least 8 consecutive nucleotides of any one of the nucleic acid sequences SEQ ID Nos: 392, 1653 and/or the nucleic acid sequences complementary thereto (nucleotide sequences corresponding to the various variable sequences of the CRISPR2 locus of the serotype Manhattan);

set S44-1, comprising or constituted of at least one probe comprising at least or constituted of at least 8 consecutive nucleotides of any one of the nucleic acid sequences SEQ ID Nos: 96 to 155 and/or the nucleic acid sequences complementary thereto (nucleotide sequences corresponding to the various variable sequences of the CRISPR1 locus of certain serotypes of the species *S. bongori*);

set S44-2, comprising or constituted of at least one probe comprising at least or constituted of at least 8 consecutive nucleotides of any one of the nucleic acid sequences SEQ ID Nos: 156 to 195, 1421 to 1430 and/or the nucleic acid sequences complementary thereto (nucleotide sequences corresponding to the various variable sequences of the CRISPR2 locus of certain serotypes of the species *S. bongori*);

set S45-1, comprising or constituted of at least one probe comprising at least or constituted of at least 8 consecutive nucleotides of any one of the nucleic acid sequences SEQ ID Nos: 962, 1106, 1133, 1804, 1808 and/or the nucleic acid sequences complementary thereto (nucleotide sequences corresponding to the various variable sequences of the CRISPR1 locus of the serotype Abony);

set S45-2, comprising or constituted of at least one probe comprising at least or constituted of at least 8 consecutive nucleotides of any one of the nucleic acid sequences SEQ ID Nos: 972, 989, 1334 to 1339, 1474, 1499 and/or the nucleic acid sequences complementary thereto (nucleotide sequences corresponding to the various variable sequences of the CRISPR2 locus of the serotype Abony);

set S46-1, comprising or constituted of at least one probe comprising at least or constituted of at least 8 consecutive nucleotides of any one of the nucleic acid sequences SEQ ID Nos: 448, 860 to 875, 882, 883, 1340 to 1345, 1721 to 1723 and/or the nucleic acid sequences complementary thereto (nucleotide sequences corresponding to the various variable sequences of the CRISPR1 locus of the serotype Aesch);

set S46-2, comprising or constituted of at least one probe comprising at least or constituted of at least 8 consecutive nucleotides of any one of the nucleic acid sequences SEQ ID Nos: 563, 625, 626, 885, 887 to 893, 896, 933, 1346 to 1348, 1749, 1759 and/or the nucleic acid sequences complementary thereto (nucleotide sequences corresponding to the various variable sequences of the CRISPR2 locus of the serotype Aesch);

set S47-1, comprising or constituted of at least one probe comprising at least or constituted of at least 8 consecutive nucleotides of any one of the nucleic acid sequences SEQ ID Nos: 834, 1120, 1349, 1350, 1351, 1713, 1718 and/or the nucleic acid sequences complementary thereto (nucleotide sequences corresponding to the various variable sequences of the CRISPR1 locus of the serotype Albany);

set S47-2, comprising or constituted of at least one probe comprising at least or constituted of at least 8 consecutive nucleotides of any one of the nucleic acid sequences SEQ ID Nos: 842, 852, 1352, 1353 and/or the nucleic acid sequences complementary thereto (nucleotide sequences corresponding to the various variable sequences of the CRISPR2 locus of the serotype Albany);

set S48-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Arechavalata);

set S48-2, comprising or constituted of at least one probe comprising at least or constituted of at least 8 consecutive nucleotides of any one of the nucleic acid sequences SEQ ID Nos: 225, 227 to 231, 1398 and/or the nucleic acid sequences complementary thereto (nucleotide sequences corresponding to the various variable sequences of the CRISPR2 locus of the serotype Arechavalata);

set S49-1, comprising or constituted of at least one probe comprising at least or constituted of at least 8 consecutive nucleotides of any one of the nucleic acid sequences SEQ ID Nos: 448, 449, 860, 871 to 873, 878, 895, 903 to 905, 907, 1719 to 1721, 1745 and/or the nucleic acid sequences complementary thereto (nucleotide sequences corresponding to the various variable sequences of the CRISPR1 locus of the serotype Bardo);

set S49-2, comprising or constituted of at least one probe comprising at least or constituted of at least 8 consecutive nucleotides of any one of the nucleic acid sequences SEQ ID Nos: 563, 622, 626, 885, 886 to 890, 893, 896, 907, 910 to 915, 933, 1756 to 1758 and/or the nucleic acid sequences complementary thereto (nucleotide sequences corresponding to the various variable sequences of the CRISPR2 locus of the serotype Bardo);

set S50-1, comprising or constituted of at least one probe comprising at least or constituted of at least 8 consecutive nucleotides of any one of the nucleic acid sequences SEQ ID Nos: 82, 1401 and/or the nucleic acid sequences complementary thereto (nucleotide sequences corresponding to the various variable sequences of the CRISPR1 locus of the serotype Berta);

set S50-2, comprising or constituted of at least one probe comprising at least or constituted of at least 8 consecutive nucleotides of any one of the nucleic acid sequences SEQ ID Nos: 246, 918, 933, 1401, 1448 and/or the nucleic acid sequences complementary thereto (nucleotide sequences corresponding to the various variable sequences of the CRISPR2 locus of the serotype Berta);

set S51-1, comprising or constituted of at least one probe comprising at least or constituted of at least 8 consecutive nucleotides of any one of the nucleic acid sequences SEQ ID Nos: 1, 37, 1106, 1402 to 1416, 2055 and/or the nucleic acid sequences complementary thereto (nucleotide sequences corresponding to the various variable sequences of the CRISPR1 locus of the serotype Bispebjerg);

set S51-2, comprising or constituted of at least one probe comprising at least or constituted of at least 8 consecutive nucleotides of any one of the nucleic acid sequences SEQ ID Nos: 2 to 4, 9, 1417 to 1420, 1547, 1572 and/or the nucleic acid sequences complementary thereto (nucleotide sequences corresponding to the various variable sequences of the CRISPR2 locus of the serotype Bispebjerg);

set S52-1, comprising or constituted of at least one probe comprising at least or constituted of at least 8 consecutive nucleotides of any one of the nucleic acid sequences SEQ ID Nos: 379, 380, 383, 385, 387, 389 to 391 and/or the nucleic acid sequences complementary thereto (nucleotide sequences corresponding to the various variable sequences of the CRISPR1 locus of the serotype Blegdam);

set S52-2, comprising or constituted of at least one probe comprising at least or constituted of at least 8 consecutive nucleotides of any one of the nucleic acid sequences SEQ ID Nos: 392 to 394, 404, 407, 412, 413, 519 and/or the nucleic acid sequences complementary thereto (nucleotide sequences corresponding to the various variable sequences of the CRISPR2 locus of the serotype Blegdam);

set S53-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Chester);

set S53-2, comprising or constituted of at least one probe comprising at least or constituted of at least 8 consecutive nucleotides of any one of the nucleic acid sequences SEQ ID Nos: 933, 1445 to 1447 and/or the nucleic acid sequences complementary thereto (nucleotide sequences corresponding to the various variable sequences of the CRISPR2 locus of the serotype Chester);

set S54-1, comprising or constituted of at least one probe comprising at least or constituted of at least 8 consecutive nucleotides of any one of the nucleic acid sequences SEQ ID Nos: 1449 to 1454, 1460, 1467 to 1473 and/or the nucleic acid sequences complementary thereto (nucleotide sequences corresponding to the various variable sequences of the CRISPR1 locus of the serotype Concord);

set S54-2, comprising or constituted of at least one probe comprising at least or constituted of at least 8 consecutive nucleotides of any one of the nucleic acid sequences SEQ ID Nos: 972, 1474 to 1493, 1495 to 1499 and/or the nucleic acid sequences complementary thereto (nucleotide sequences corresponding to the various variable sequences of the CRISPR2 locus of the serotype Concord);

set S55-1, comprising or constituted of at least one probe comprising at least or constituted of at least 8 consecutive nucleotides of any one of the nucleic acid sequences SEQ ID Nos: 1106, 1107 to 1109, 1123, 1128 to 1131, 1133, 1137 to 1140, 1550, 1559 to 1561 and/or the nucleic acid sequences complementary thereto (nucleotide sequences corresponding to the various variable sequences of the CRISPR1 locus of the serotype Crossness);

set S55-2, comprising or constituted of at least one probe comprising at least or constituted of at least 8 consecutive nucleotides of any one of the nucleic acid sequences SEQ ID Nos: 455, 1144, 1145, 1149 to 1153, 1155 to 1160, 1163, 1172 to 1174 and/or the nucleic acid sequences complementary thereto (nucleotide sequences corresponding to the various variable sequences of the CRISPR2 locus of the serotype Crossness);

set S56-1, comprising or constituted of at least one probe comprising at least or constituted of at least 8 consecutive nucleotides of any one of the nucleic acid sequences SEQ ID Nos: 834, 1120, 1349 to 1351, 1713, 1718 and/or the nucleic acid sequences complementary thereto (nucleotide sequences corresponding to the various variable sequences of the CRISPR1 locus of the serotype Duesseldorf);

set S56-2, comprising or constituted of at least one probe comprising at least or constituted of at least 8 consecutive nucleotides of any one of the nucleic acid sequences SEQ ID Nos: 842, 852, 1352, 1353, 1501 to 1503 and/or the nucleic acid sequences complementary thereto (nucleotide sequences corresponding to the various variable sequences of the CRISPR2 locus of the serotype Duesseldorf);

set S57-1, comprising or constituted of at least one probe comprising at least or constituted of at least 8 consecutive nucleotides of any one of the nucleic acid sequences SEQ ID Nos: 941, 1504 to 1508 and/or the nucleic acid sequences complementary thereto (nucleotide sequences corresponding to the various variable sequences of the CRISPR1 locus of the serotype Emek);

set S57-2, comprising or constituted of at least one probe comprising at least or constituted of at least 8 consecutive nucleotides of any one of the nucleic acid sequences SEQ ID Nos: 1260, 1509 to 1524, 1526, 1527 and/or the nucleic acid sequences complementary thereto (nucleotide sequences corresponding to the various variable sequences of the CRISPR2 locus of the serotype Emek);

set S58-1, comprising or constituted of at least one probe comprising at least or constituted of at least 8 consecutive nucleotides of the nucleic acid sequence SEQ ID No.: 558 and/or the nucleic acid sequence complementary thereto (nucleotide sequences corresponding to the variable sequence of the CRISPR1 locus of the serotype Fulica);

set S58-2, comprising or constituted of at least one probe comprising at least or constituted of at least 8 consecutive nucleotides of any one of the nucleic acid sequences SEQ ID Nos: 2, 4, 5, 1333, 1547 and/or the nucleic acid sequences complementary thereto (nucleotide sequences corresponding to the various variable sequences of the CRISPR2 locus of the serotype Fulica);

set S59-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Gueuletapee);

set S59-2, comprising or constituted of at least one probe comprising at least or constituted of at least 8 consecutive nucleotides of any one of the nucleic acid sequences SEQ ID Nos: 597, 918 to 925, 933, 1549 and/or the nucleic acid sequences complementary thereto (nucleotide sequences corresponding to the various variable sequences of the CRISPR2 locus of the serotype Gueuletapee);

set S60-1, comprising or constituted of at least one probe comprising at least or constituted of at least 8 consecutive nucleotides of any one of the nucleic acid sequences SEQ ID Nos: 1106 to 1109, 1111 to 1116, 1118, 1123, 1128 to 1131, 1133, 1137 to 1140, 1150, 1151, 1555 to 1562 and/or the nucleic acid sequences complementary thereto (nucleotide sequences corresponding to the various variable sequences of the CRISPR1 locus of the serotype Heidelberg);

set S60-2, comprising or constituted of at least one probe comprising at least or constituted of at least 8 consecutive nucleotides of any one of the nucleic acid sequences SEQ ID Nos: 455, 1144, 1145, 1149 to 1153, 1155 to 1163, 1172 to 1174, 1563 and/or the nucleic acid sequences complementary thereto (nucleotide sequences corresponding to the various variable sequences of the CRISPR2 locus of the serotype Heidelberg);

set S61-1, comprising or constituted of at least one probe comprising at least or constituted of at least 8 consecutive nucleotides of any one of the nucleic acid sequences SEQ ID Nos: 558, 1565 to 1571 and/or the nucleic acid sequences complementary thereto (nucleotide sequences corresponding to the various variable sequences of the CRISPR1 locus of the serotype Hessarek);

set S61-2, comprising or constituted of at least one probe comprising at least or constituted of at least 8 consecutive nucleotides of any one of the nucleic acid sequences SEQ ID Nos: 2 to 4, 1547, 1572, 1573 and/or the nucleic acid sequences complementary thereto (nucleotide sequences corresponding to the various variable sequences of the CRISPR2 locus of the serotype Hessarek);

set S62-1, comprising or constituted of at least one probe comprising at least or constituted of at least 8 consecutive nucleotides of any one of the nucleic acid sequences SEQ ID Nos: 1591, 1592, 1667 and/or the nucleic acid sequences complementary thereto (nucleotide sequences corresponding to the various variable sequences of the CRISPR1 locus of the serotype Itami);

set S62-2, comprising or constituted of at least one probe comprising at least or constituted of at least 8 consecutive nucleotides of any one of the nucleic acid sequences SEQ ID Nos: 918, 1593 to 1600, 1744 and/or the nucleic acid sequences complementary thereto (nucleotide sequences corresponding to the various variable sequences of the CRISPR2 locus of the serotype Itami);

set S63-1, comprising or constituted of at least one probe comprising at least or constituted of at least 8 consecutive nucleotides of any one of the nucleic acid sequences SEQ ID Nos: 1601 to 1606, 1687 and/or the nucleic acid sequences complementary thereto (nucleotide sequences corresponding to the various variable sequences of the CRISPR1 locus of the serotype Javiana);

set S63-2, comprising or constituted of at least one probe comprising at least or constituted of at least 8 consecutive nucleotides of any one of the nucleic acid sequences SEQ ID Nos: 589 to 601, 973, 1607, 1608 and/or the nucleic acid sequences complementary thereto (nucleotide sequences corresponding to the various variable sequences of the CRISPR2 locus of the serotype Javiana);

set S64-1, comprising or constituted of at least one probe comprising at least or constituted of at least 8 consecutive nucleotides of any one of the nucleic acid sequences SEQ ID Nos: 1609 to 1621, 1494, 1525 and/or the nucleic acid sequences complementary thereto (nucleotide sequences corresponding to the various variable sequences of the CRISPR1 locus of the serotype Johannesburg);

set S64-2, comprising or constituted of at least one probe comprising at least or constituted of at least 8 consecutive nucleotides of any one of the nucleic acid sequences SEQ ID Nos: 918, 1697, 1698 and/or the nucleic acid sequences complementary thereto (nucleotide sequences corresponding to the various variable sequences of the CRISPR2 locus of the serotype Johannesburg);

set S65-1, comprising or constituted of at least one probe comprising at least or constituted of at least 8 consecutive nucleotides of any one of the nucleic acid sequences SEQ ID Nos: 444, 448, 1184, 1622 to 1637 and/or the nucleic acid sequences complementary thereto (nucleotide sequences corresponding to the various variable sequences of the CRISPR1 locus of the serotype Kentucky);

set S65-2, comprising or constituted of at least one probe comprising at least or constituted of at least 8 consecutive nucleotides of any one of the nucleic acid sequences SEQ ID Nos: 385, 519, 1638 to 1652, 1746 and/or the nucleic acid sequences complementary thereto (nucleotide sequences corresponding to the various variable sequences of the CRISPR2 locus of the serotype Kentucky);

set S66-1, comprising or constituted of at least one probe comprising at least or constituted of at least 8 consecutive nucleotides of the nucleic acid sequence SEQ ID No.: 67 and/or the nucleic acid sequence complementary thereto (nucleotide sequences corresponding to the variable sequence of the CRISPR1 locus of the serotype Kundunchi);

set S66-2, comprising or constituted of at least one probe comprising at least or constituted of at least 8 consecutive nucleotides of any one of the nucleic acid sequences SEQ ID Nos: 972, 983, 989, 1201, 1204, 1205, 1210 to 1212 and/or the nucleic acid sequences complementary thereto (nucleotide sequences corresponding to the various variable sequences of the CRISPR2 locus of the serotype Kundunchi);

set S67-1, comprising or constituted of at least one probe comprising at least or constituted of at least 8 consecutive nucleotides of any one of the nucleic acid sequences SEQ ID Nos: 448, 449, 860, 871, 878 to 881, 1721, 1724 and/or the nucleic acid sequences complementary thereto (nucleotide sequences corresponding to the various variable sequences of the CRISPR1 locus of the serotype Lindenburg);

set S67-2, comprising or constituted of at least one probe comprising at least or constituted of at least 8 consecutive nucleotides of any one of the nucleic acid sequences SEQ ID Nos: 563, 622, 885, 886, 896, 907, 910 to 915, 933, 1748, 1757 and/or the nucleic acid sequences complementary thereto (nucleotide sequences corresponding to the various variable sequences of the CRISPR2 locus of the serotype Lindenburg);

set S68-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Maracaibo);

set S68-2, comprising or constituted of at least one probe comprising at least or constituted of at least 8 consecutive nucleotides of any one of the nucleic acid sequences SEQ ID Nos: 1240, 1247, 1248, 1654 to 1656 and/or the nucleic acid sequences complementary thereto (nucleotide sequences corresponding to the various variable sequences of the CRISPR2 locus of the serotype Maracaibo);

set S69-1, comprising or constituted of at least one probe comprising at least or constituted of at least 8 consecutive nucleotides of any one of the nucleic acid sequences SEQ ID Nos: 627, 834, 1120, 1660 to 1669 and/or the nucleic acid sequences complementary thereto (nucleotide sequences corresponding to the various variable sequences of the CRISPR1 locus of the serotype Mississippi);

set S69-2, comprising or constituted of at least one probe comprising at least or constituted of at least 8 consecutive nucleotides of any one of the nucleic acid sequences SEQ ID Nos: 842, 1670 and/or the nucleic acid sequences complementary thereto (nucleotide sequences corresponding to the various variable sequences of the CRISPR2 locus of the serotype Mississippi);

set S70-1, comprising or constituted of at least one probe comprising at least or constituted of at least 8 consecutive nucleotides of any one of the nucleic acid sequences SEQ ID Nos: 941, 942, 949, 1699 to 1712, 2109 and/or the nucleic acid sequences complementary thereto (nucleotide sequences corresponding to the various variable sequences of the CRISPR1 locus of the serotype Muenchen);

set S70-2, comprising or constituted of at least one probe comprising at least or constituted of at least 8 consecutive nucleotides of any one of the nucleic acid sequences SEQ ID Nos: 392, 1653 and/or the nucleic acid sequences complementary thereto (nucleotide sequences corresponding to the various variable sequences of the CRISPR2 locus of the serotype Muenchen);

set S71-1, comprising or constituted of at least one probe comprising at least or constituted of at least 8 consecutive nucleotides of any one of the nucleic acid sequences SEQ ID Nos: 11, 1120, 1497, 1760 to 1775, 1809 and/or the nucleic acid sequences complementary thereto (nucleotide sequences corresponding to the various variable sequences of the CRISPR1 locus of the serotype Niarembe);

set S71-2, comprising or constituted of at least one probe comprising at least or constituted of at least 8 consecutive nucleotides of any one of the nucleic acid sequences SEQ ID Nos: 90, 1776 to 1785 and/or the nucleic acid sequences complementary thereto (nucleotide sequences corresponding to the various variable sequences of the CRISPR2 locus of the serotype Niarembe);

set S72-1, comprising or constituted of at least one probe comprising at least or constituted of at least 8 consecutive nucleotides of any one of the nucleic acid sequences SEQ ID Nos: 666, 1786 to 1791 and/or the nucleic acid sequences complementary thereto (nucleotide sequences corresponding to the various variable sequences of the CRISPR1 locus of the serotype Overvecht);

set S72-2, comprising or constituted of at least one probe comprising at least or constituted of at least 8 consecutive nucleotides of any one of the nucleic acid sequences SEQ ID Nos: 783, 1146, 1178, 1179, 1181, 1792 to 1799, 1801 and/or the nucleic acid sequences complementary thereto (nucleotide sequences corresponding to the various variable sequences of the CRISPR2 locus of the serotype Overvecht);

set S73-1, comprising or constituted of at least one probe comprising at least or constituted of at least 8 consecutive nucleotides of the nucleic acid sequences SEQ ID No.: 917 and/or the nucleic acid sequence complementary thereto (nucleotide sequences corresponding to the variable sequence of the CRISPR1 locus of the serotype Poona);

set S73-2, comprising or constituted of at least one probe comprising at least or constituted of at least 8 consecutive nucleotides of any one of the nucleic acid sequences SEQ ID Nos: 82, 87, 918, 933, 1826 and/or the nucleic acid sequences complementary thereto (nucleotide sequences corresponding to the various variable sequences of the CRISPR2 locus of the serotype Poona);

set S74-1, comprising or constituted of at least one probe comprising at least or constituted of at least 8 consecutive nucleotides of any one of the nucleic acid sequences SEQ ID Nos: 295 to 297, 307, 313, 317, 323, 1120, 1825, 1827 to 1837, 2023 and/or the nucleic acid sequences complementary thereto (nucleotide sequences corresponding to the various variable sequences of the CRISPR1 locus of the serotype Potsdam);

set S74-2, comprising or constituted of at least one probe comprising at least or constituted of at least 8 consecutive nucleotides of any one of the nucleic acid sequences SEQ ID Nos: 663, 1304, 1838 to 1847 and/or the nucleic acid sequences complementary thereto (nucleotide sequences corresponding to the various variable sequences of the CRISPR2 locus of the serotype Potsdam);

set S75-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Reading);

set S75-2, comprising or constituted of at least one probe comprising at least or constituted of at least 8 consecutive nucleotides of the nucleic acid sequence SEQ ID No.: 225 and/or the nucleic acid sequence complementary thereto (nucleotide sequences corresponding to the variable sequence of the CRISPR2 locus of the serotype Reading);

set S76-1, comprising or constituted of at least one probe comprising at least or constituted of at least 8 consecutive nucleotides of any one of the nucleic acid sequences SEQ ID Nos: 379, 380, 383 to 385, 387, 389, 390 and/or the nucleic acid sequences complementary thereto (nucleotide sequences corresponding to the various variable sequences of the CRISPR1 locus of the serotype Rosenberg);

set S76-2, comprising or constituted of at least one probe comprising at least or constituted of at least 8 consecutive nucleotides of any one of the nucleic acid sequences SEQ ID Nos: 392, 393, 404, 407 to 413 and/or the nucleic acid sequences complementary thereto (nucleotide sequences corresponding to the various variable sequences of the CRISPR2 locus of the serotype Rosenberg);

set S77-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Rubislaw);

set S77-2, comprising or constituted of at least one probe comprising at least or constituted of at least 8 consecutive nucleotides of the nucleic acid sequence SEQ ID No.: 225 and/or the nucleic acid sequence complementary thereto (nucleotide sequences corresponding to the variable sequence of the CRISPR1 locus of the serotype Rubislaw);

set S78-1, comprising or constituted of at least one probe comprising at least or constituted of at least 8 consecutive nucleotides of any one of the nucleic acid sequences SEQ ID Nos: 1525, 1609 to 1621 and/or the nucleic acid sequences complementary thereto (nucleotide sequences corresponding to the various variable sequences of the CRISPR2 locus of the serotype Sandiego);

set S78-2, comprising or constituted of at least one probe comprising at least or constituted of at least 8 consecutive nucleotides of any one of the nucleic acid sequences SEQ ID Nos: 225 to 227, 229 to 231 and/or the nucleic acid sequences complementary thereto (nucleotide sequences corresponding to the various variable sequences of the CRISPR2 locus of the serotype Sandiego);

set S79-1, comprising or constituted of at least one probe comprising at least or constituted of at least 8 consecutive nucleotides of any one of the nucleic acid sequences SEQ ID Nos: 1106, 1456, 1917 to 1924 and/or the nucleic acid sequences complementary thereto (nucleotide sequences corresponding to the various variable sequences of the CRISPR1 locus of the serotype Stourbridge);

set S79-2, comprising or constituted of at least one probe comprising at least or constituted of at least 8 consecutive nucleotides of any one of the nucleic acid sequences SEQ ID Nos: 918, 1093, 1925 to 1936 and/or the nucleic acid sequences complementary thereto (nucleotide sequences corresponding to the various variable sequences of the CRISPR2 locus of the serotype Stourbridge);

set S80-1, comprising or constituted of at least one probe comprising at least or constituted of at least 8 consecutive nucleotides of any one of the nucleic acid sequences SEQ ID Nos: 1961 to 1963 and/or the nucleic acid sequences complementary thereto (nucleotide sequences corresponding to the various variable sequences of the CRISPR1 locus of the serotype Tallahassee);

set S80-2, comprising or constituted of at least one probe comprising at least or constituted of at least 8 consecutive nucleotides of any one of the nucleic acid sequences SEQ ID Nos: 25, 603, 2127, 2133, 1964 to 1966 and/or the nucleic acid sequences complementary thereto (nucleotide sequences corresponding to the various variable sequences of the CRISPR2 locus of the serotype Tallahassee);

set S81-1, comprising or constituted of at least one probe comprising at least or constituted of at least 8 consecutive nucleotides of any one of the nucleic acid sequences SEQ ID Nos: 67, 929, 1967 to 2005 and/or the nucleic acid sequences complementary thereto (nucleotide sequences corresponding to the various variable sequences of the CRISPR1 locus of the serotype Tennessee);

set S81-2, comprising or constituted of at least one probe comprising at least or constituted of at least 8 consecutive nucleotides of any one of the nucleic acid sequences SEQ ID Nos: 24, 769, 1550, 1659, 2006 to 2022 and/or the nucleic acid sequences complementary thereto (nucleotide sequences corresponding to the various variable sequences of the CRISPR2 locus of the serotype Tennessee);

set S82-1, comprising or constituted of at least one probe comprising at least or constituted of at least 8 consecutive nucleotides of the nucleic acid sequence SEQ ID No.: 916 and/or the nucleic acid sequence complementary thereto (nucleotide sequences corresponding to the variable sequence of the CRISPR1 locus of the serotype Urbana);

set S82-2, comprising or constituted of at least one probe comprising at least or constituted of at least 8 consecutive nucleotides of any one of the nucleic acid sequences SEQ ID Nos: 1697, 1698, 1800 and/or the nucleic acid sequences complementary thereto (nucleotide sequences corresponding to the various variable sequences of the CRISPR2 locus of the serotype Urbana);

set S83-1, comprising or constituted of at least one probe comprising at least or constituted of at least 8 consecutive nucleotides of any one of the nucleic acid sequences SEQ ID Nos: 948, 1120, 1123, 1325, 2039 to 2078 and/or the nucleic acid sequences complementary thereto (nucleotide sequences corresponding to the various variable sequences of the CRISPR1 locus of the serotype Weltevreden);

set S83-2, comprising or constituted of at least one probe comprising at least or constituted of at least 8 consecutive nucleotides of any one of the nucleic acid sequences SEQ ID Nos: 254 to 256, 2079 to 2108 and/or the nucleic acid sequences complementary thereto (nucleotide sequences corresponding to the various variable sequences of the CRISPR2 locus of the serotype Weltevreden);

set S84-1, comprising or constituted of at least one probe comprising at least or constituted of at least 8 consecutive nucleotides of any one of the nucleic acid sequences SEQ ID Nos: 1312, 1690, 2141, 2142 and/or the nucleic acid sequences complementary thereto (nucleotide sequences corresponding to the various variable sequences of the CRISPR1 locus of the serotype Zaiman);

set S84-2, comprising or constituted of at least one probe comprising at least or constituted of at least 8 consecutive nucleotides of any one of the nucleic acid sequences SEQ ID Nos: 1697, 1698, 1800, 1924, 2143, 2144 and/or the nucleic acid sequences complementary thereto (nucleotide sequences corresponding to the various variable sequences of the CRISPR2 locus of the serotype Zaiman); and (ii) detection of the hybridized probes.

According to one advantageous mode of this aspect of the invention, when the first two nucleotides (in the 5' position) of said nucleic acid sequences are the dinucleotide "AC" or "AT", then said probes comprise at least or are constituted of at least 8 consecutive nucleotides of these nucleic acid sequences without said nucleotides "AC" or "AT" (i.e., in which said nucleotides "AC" or "AT" are absent), and/or the nucleic acid sequences complementary thereto.

For the purpose of the present invention, the term "at least one probe" is intended to mean one, several or all of the probes of one of the sets of probes defined above.

The term "probe" denotes an oligonucleotide, constituted of at least 8 nucleotides, having the same technical characteristics as a primer (defined above), except that its 3'OH end may not be capable of binding a DNA polymerase. A probe (an oligonucleotide probe) has a specificity of hybridization under suitable conditions (in particular indicated hereinafter) so as to form a hybridization complex with a target nucleic acid. The probes according to the present invention can be synthesized or can be derived from suitable biological preparations according to methods well known to those skilled in the art. Preferably, the probes according to the present invention are DNA and have a length of less than or equal to 150 nucleotides, i.e. less than or equal to 140, 130, 120, 110, 100, 90, 80, 70, 60, 50, 40, 30, 20 or 10 nucleotides. More preferably, the probes according to the present invention have a length of between 8 and 76 nucleotides, preferably between 8 and 34 nucleotides.

According to one advantageous arrangement of the above embodiment, step (b) is carried out by hybridization with at least one probe of each of sets S1-1 to S6-2 (sets of probes for typing and/or subtyping bacteria of the Salmonella genus of serotype Typhimurium, Enteritidis, Hadar, Virchow, Infantis and Typhi).

According to another advantageous arrangement of the above embodiment, step (b) is carried out by hybridization with at least one probe of each of sets S1-1 to S10-2 (sets of probes for typing and/or subtyping bacteria of the Salmonella genus, in addition to those of serotypes mentioned above, those of serotypes Newport, Derby, Kottbus and Indiana).

According to yet another advantageous arrangement of the above embodiment, step (b) is carried out by hybridization with at least one probe of each of sets S1-1 to S44-2 (sets of probes for typing and/or subtyping all the serotypes of bacteria of the Salmonella genus mentioned above).

The subject of the present invention is also a probe or a set of probes capable of identifying a bacterium of the Salmonella genus, each probe comprising at least or being constituted of at least 8 consecutive nucleotides of any one of the nucleic acid sequences selected from the group constituted of the nucleic acid sequences SEQ ID Nos: 1 to 256, 258 to 614, 616 to 876, 878 to 1043, 1045 to 1147, 1149 to 1302, 1304 to 1325, 1333 to 2150 and the nucleic acid sequences complementary thereto.

The probes and primers according to the present invention are capable of hybridizing to a target nucleic acid under stringent conditions as described below or well known to those skilled in the art (see, for example, Sambrook J. et al., Molecular Cloning: A Laboratory Manual. 2000. Third Edition; Ausubel F M. et al., Current Protocols in Molecular Biology, Greene Publishing Assoc. and Wiley-Interscience 1987 & Suppl. 49, 2000). Typically, the parameters that define the stringency conditions depend on the use (i) of a low ionic strength and of a high temperature for the washing, for example 0.015 M sodium chloride/0.0015 M sodium citrate/0.1% sodium dodecyl sulfate (SDS) at 50° C.; (ii) of a denaturing agent during the step of hybridization of the primer or of the probe with a target nucleic acid, such as formamide, for example, 50% (v/v) of formamide with 0.1% of bovine serum albumin (BSA)/0.1% of Ficoll/0.1% of polyvinylpyrrolidone/50 mM sodium phosphate buffer at pH 6.5 with 750 mM sodium chloride, 75 mM sodium citrate at 42° C.; or (iii) of 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 µg/ml), 0.1% SDS and 10% dextran sulfate at 42° C., with washes at 42° C. in 0.2×SSC (sodium chloride/sodium citrate) and 50% formamide at 55° C., followed by a wash under high stringency conditions consisting of 0.1×SSC containing EDTA at 55° C.

According to this advantageous embodiment of the method in accordance with the invention, the amplification product comprising the CRISPR1 and/or CRISPR2 loci is labeled, hybridized to at least one of the probes as defined above and detected. For example, the (PCR) amplification product can be labeled with a cyanin of Cy5 type. The labeled product (i.e. functionally bound to at least one label) is then fragmented, mechanically or chemically, and is then hybridized (for example at a temperature of 42° C.) on a microarray-type chip comprising at least one of the probes as defined above, synthesized in situ. After washing, the hybridization signals are detected (for example using a fluorescence scanner).

The term "label" denotes an atom or a molecule capable of directly or indirectly generating a detectable and/or quantifiable signal, and which can be functionally bonded to a nucleic acid. The signal generated by a label can be detected, for example, by fluorescence, luminescence, radioactivity, colorimetry, gravimetric analysis, X-ray diffraction or absorption, magnetism, enzyme reaction, mass spectrometry, binding affinity, hybridization, radiofrequency or nanocrystals. The nucleic acids are labeled by methods known in themselves to those skilled in the art. By way of example, a nucleic acid can be labeled with a radioisotope (for example, $^{32}P$), a fluorochrome such as the cyanins Cy3 and Cy5, a cold probe such as biotin (dUTP-biotin) (biotin is a ligand for avidin or for streptavidin, which itself can be coupled to a fluorochrome or to an enzyme or taken up by an anti-avidin antibody, the signal of which is amplified). Other alternatives comprise the use of labeling with digoxigenin (dUTP-digoxigenin) revealed with anti-digoxigenin antibodies or by coupling, in the presence of glutaraldehyde, to peroxidase which will be rapidly revealed on an X-ray film by bioluminescence using 3-aminophthalic acid hydrazide (luminol).

The primers and probes according to the invention can also be labeled in such a way that the products of gene amplification or hybridization, respectively, are detected by means of the signal generated by the label to which they are bonded.

The sample according to the invention may be of very varied origin. By way of example, the sample may be a sample of food, human, animal or environmental (earth, water or waste, for example) origin.

Preferably, the sample is an isolated bacterial strain of the *Salmonella* genus.

For the purpose of the present invention, the term "isolated" means that a pure culture of a bacterial strain of the *Salmonella* genus has been obtained from a mixture of bacterial strains or from a sample of food, human, animal or environmental origin. The isolation of a bacterial strain is carried out by conventional methods (for example: streaking technique, suspension-dilution technique), known in themselves to those skilled in the art.

According to one advantageous embodiment in accordance with the invention, the method according to the invention is preceded by a step of extraction of nucleic acids present in said sample. The various bacterial DNA extraction techniques are well known to those skilled in the art.

The subject of the present invention is also a reagent for detecting or identifying the molecular type and subtype of a bacterium of the *Salmonella* genus. Said reagent is selected from the group constituted of at least one set of probes and/or one set of primers as defined above.

The subject of the present invention is also a DNA chip comprising the probes included in at least one or all the set(s) of primers as defined above (S1-1 to S44-2), or the probes included in the sets of probes S1-1 to S10-2, or else the probes included in the sets of probes S1-1 to S6-2.

The term "DNA chip" denotes a set of spots bound to a solid support (for example, glass, silicon, metal, silicone, gel or ceramic slide, or nylon or plastic membrane); each spot independently containing one or more oligonucleotides (for example, the probes of the present invention) which have been deposited thereon or synthesized in situ thereon. DNA chips are known under various names, for instance "biochips", "arrays", "microarrays" or "DNA-microarrays". The spots may range from a few millimeters to a few micrometers in size. A single DNA chip can contain ten or so to several thousand spots, each spot containing a different nucleic acid molecule (for example, a different probe). In general, a composition containing the test DNA is brought into contact with the DNA chip; the hybridization between an oligonucleotide (a probe) and the test DNA (for example, a nucleic acid fragment comprising the *Salmonella* CRISPR1 locus and/or CRISPR2 locus) can then take place under conditions known to those skilled in the art (D. Amaratunga et al., Exploration and Analysis of DNA Microarray and Protein Array Data, John Wiley & Sons, Inc., 2003). The detection of the hybridization then makes it possible to determine the presence of a DNA sequence that is being sought (for example, the variable sequence of a *Salmonella* CRISPR locus).

The subject of the present invention is also a kit or pack for detecting or identifying the molecular type and/or subtype of a bacterium of the *Salmonella* genus, comprising at least one set of primers and/or one set of probes, a reference base as defined above or a part of this reference base, and, optionally, a DNA chip as defined above.

The subject of the present invention is also the use of a set of primers, of a set of probes, or of a DNA chip as defined above, for detecting or identifying the molecular type and/or subtype of a bacteria of the *Salmonella* genus.

In addition to the above arrangements, the invention also comprises other arrangements, which will emerge from the description that follows, which refers to exemplary embodiments of the method which is the subject of the present invention and also to the attached drawings, in which:

FIG. 1 represents diagrammatically the separate gene amplification (FIG. 1A) or gene amplification during the same reaction (FIG. 1B) of the *Salmonella* CRISPR1 and CRISPR2 loci.

Figure 2A:
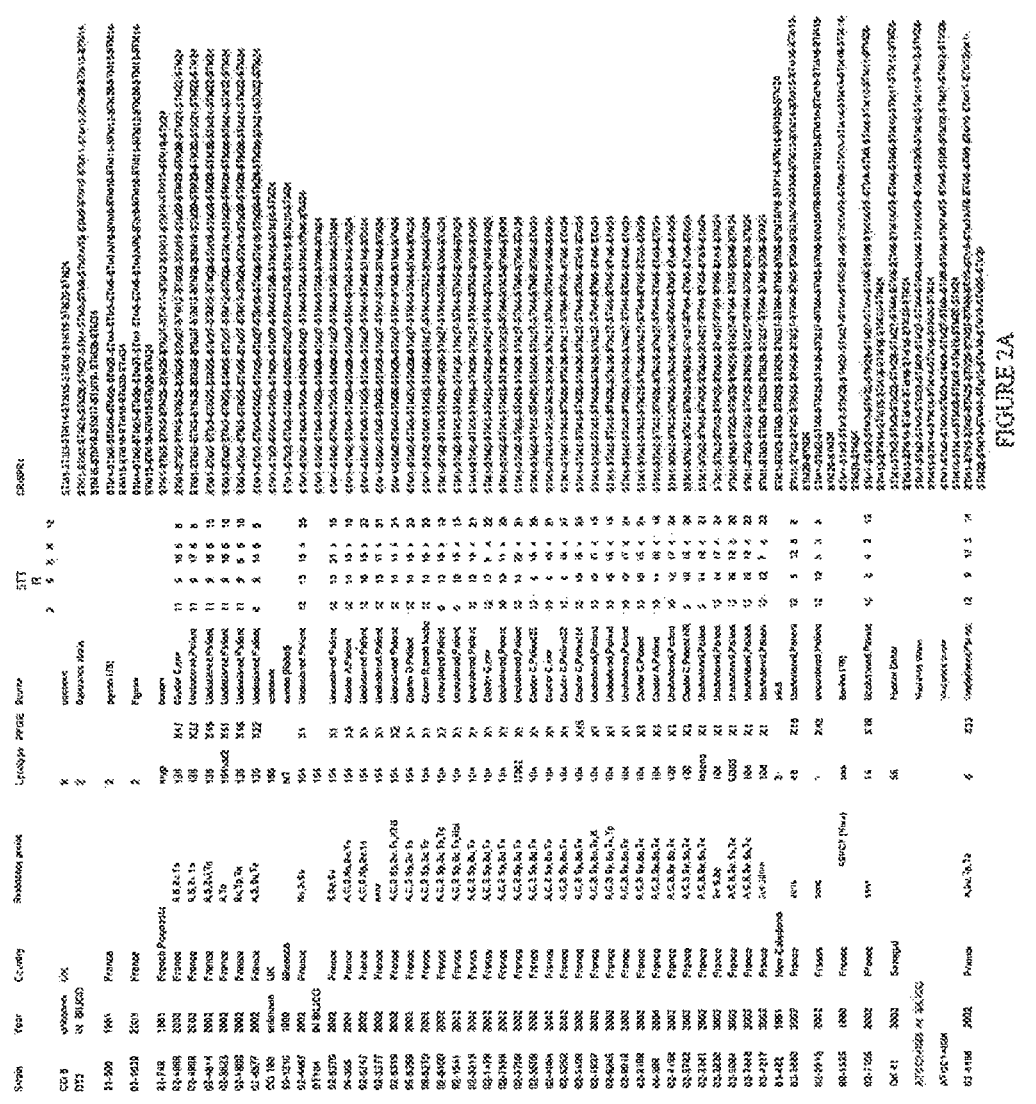
Figure 2A:
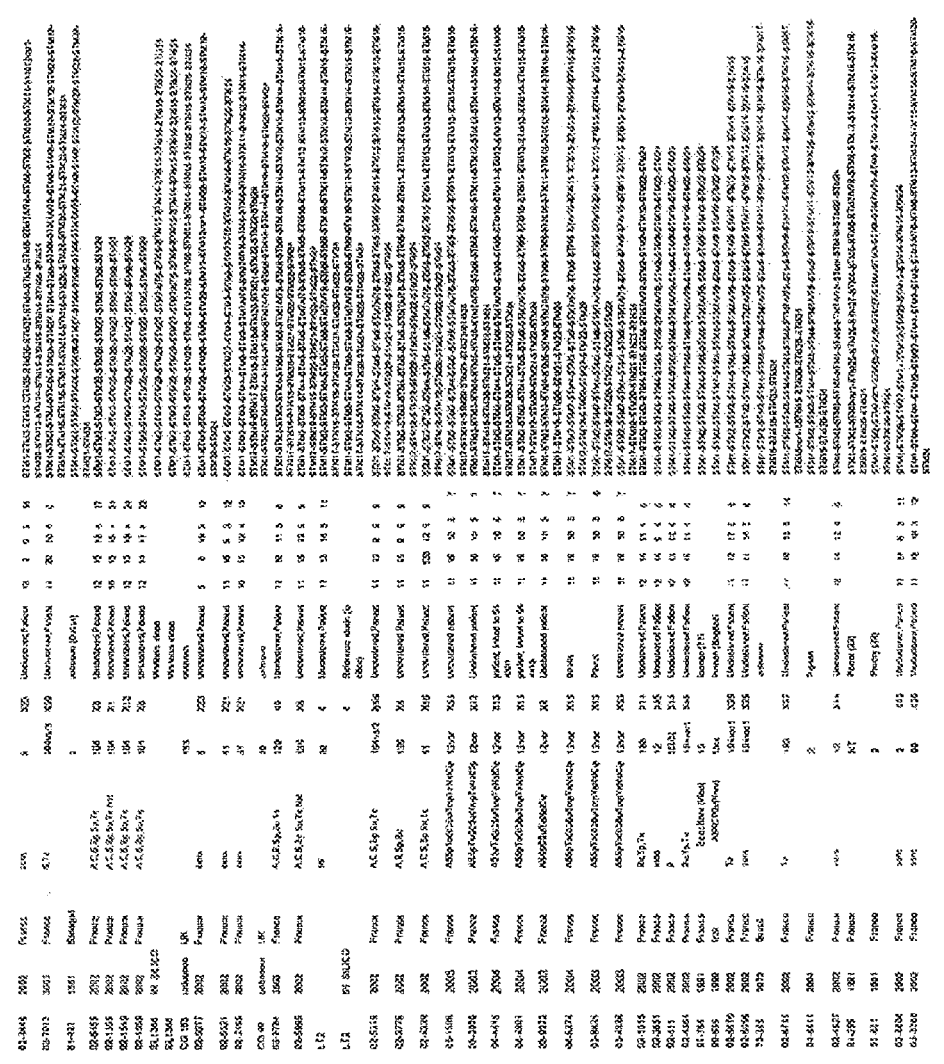
Figure 2B:
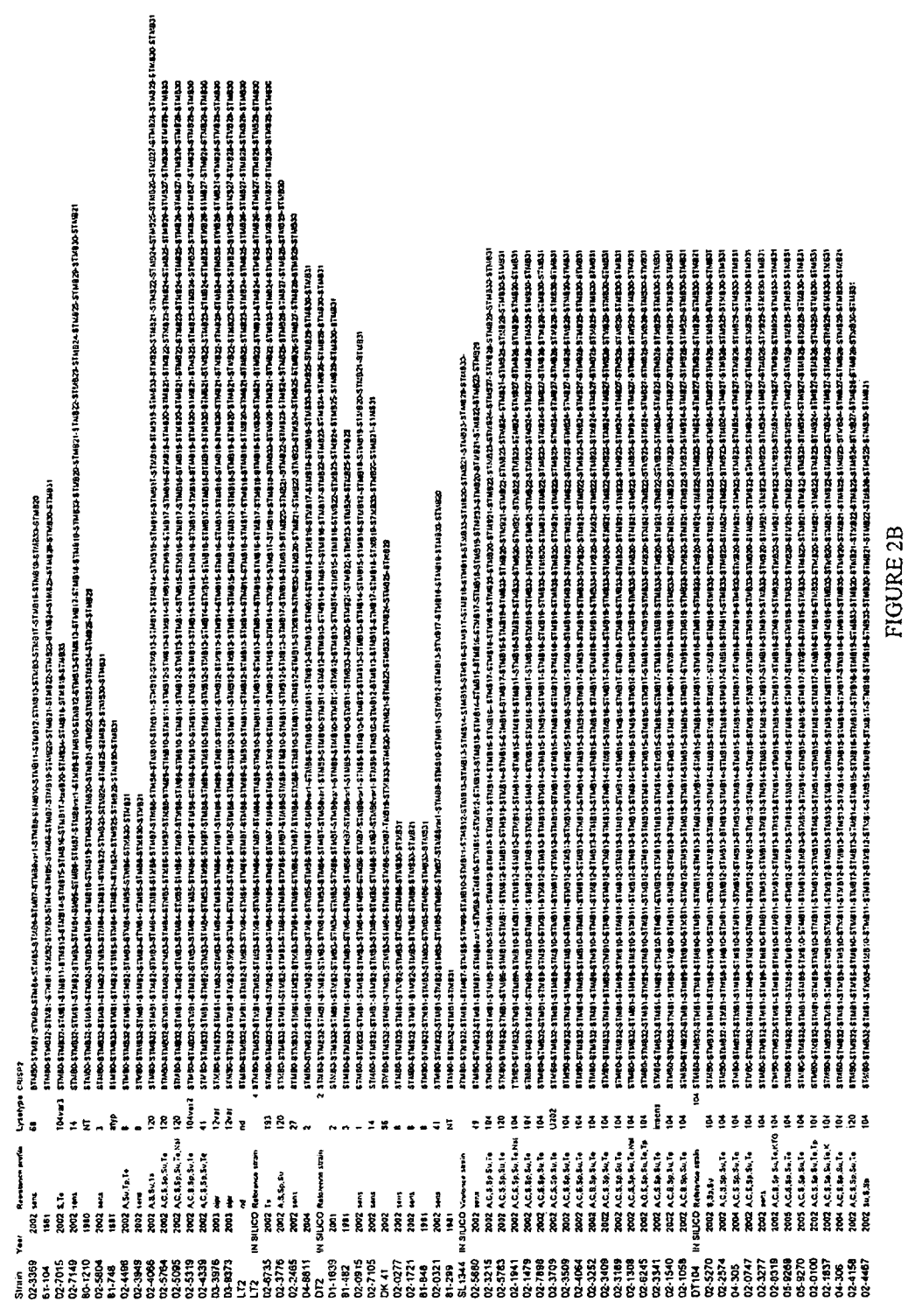

FIG. 2 indicates the variable-sequence (spacer) composition of the CRISPR1 (FIG. 2A) and CRISPR2 (FIG. 2B) loci of 91 strains of *Salmonella* of serotype Typhimurium. Also represented are the results of the conventional subtyping: antibiotype (A=amoxicillin, C=chloramphenicol, Cip=ciprofloxacin, G=gentamicin, K=kanamycin, Nal=nalidixic acid, S=streptomycin, Sp=spectinomycin, Su or Sul=sulfamides, T or To=tobramycin, Te=tetracycline, Tp or Tmp=trimethoprim, sens=sensitive), lysotype (Anderson et al., 1977, J. Hyg. (Lond) 78, 297-300), pulse-field electrophoresis profile (PFGE, method described in Weill et al., 2006, J. Clin. Microbiol. 44, 700-708; Weill et al., 2004, J. Clin. Microbiol. 42, 2432-2437), STTR (type according to the "Multiple-Locus Variable-Number Tandem Repeat Analysis" method, said method being described in Lindstedt et al., (2003, J. Clin. Microbiol. 41, 1469-1479)) and epidemiological data (of human or animal origin).

Figure 3:
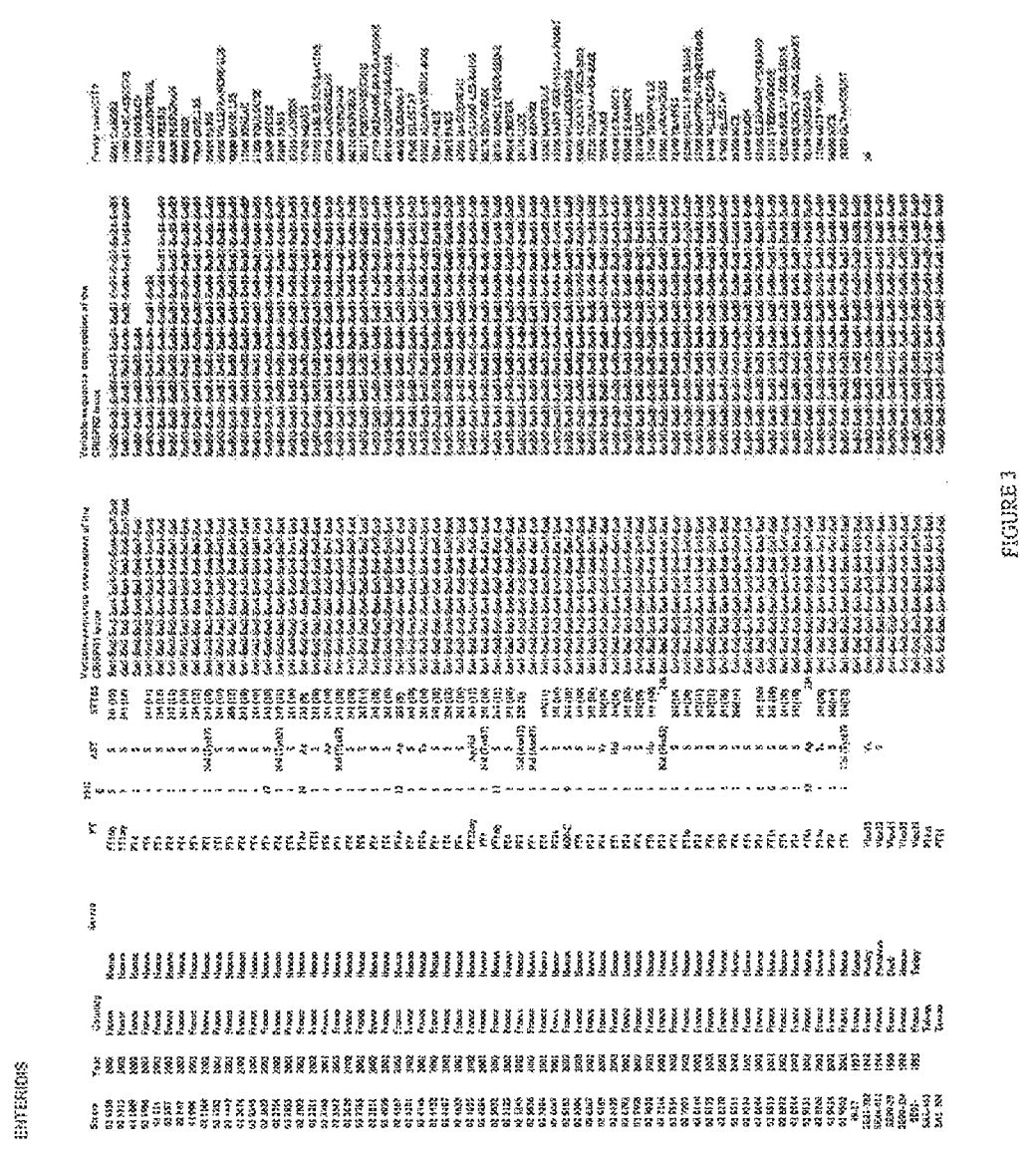
Figure 3:
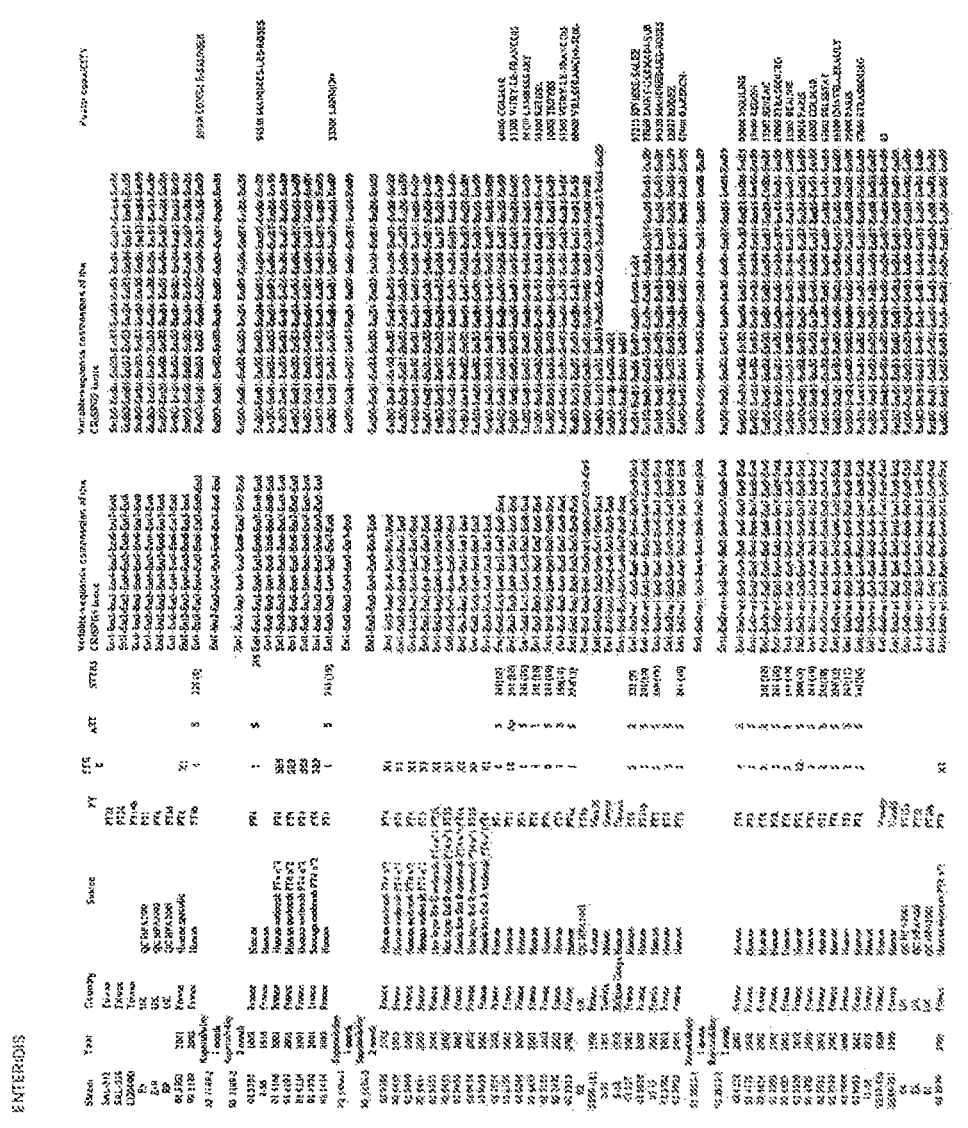
Figure 3:
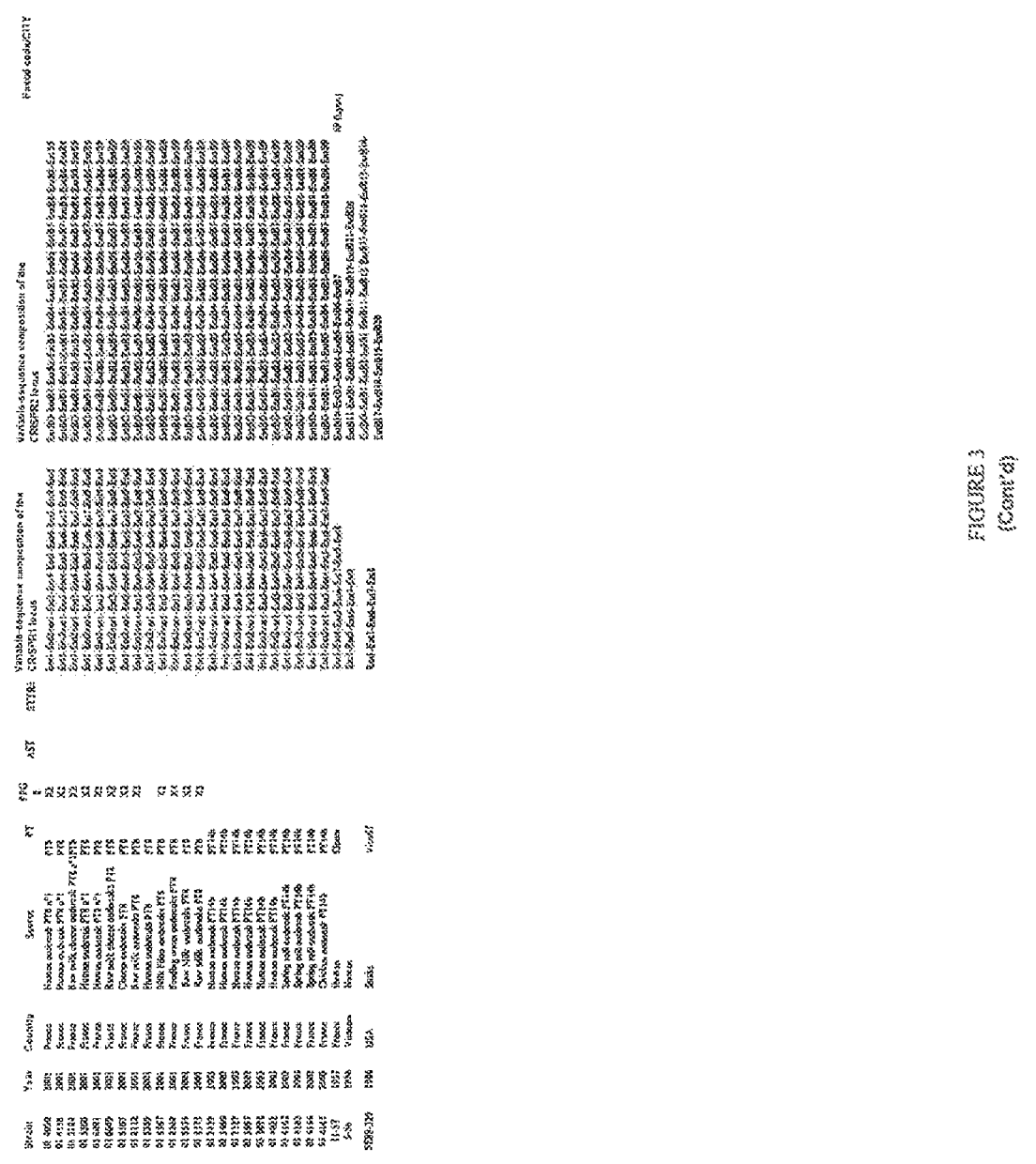
Figure 3A:
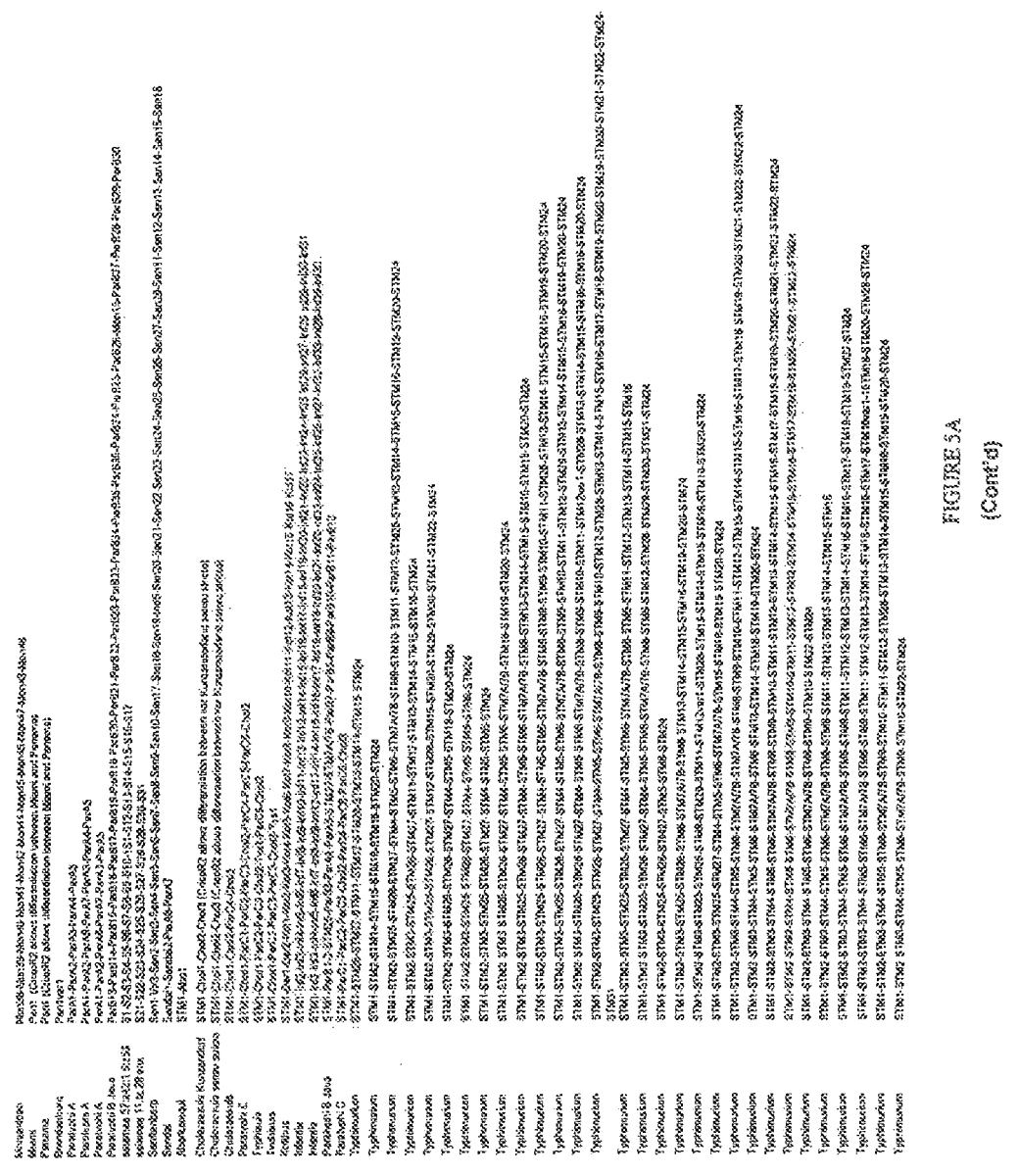
Figure 3A:
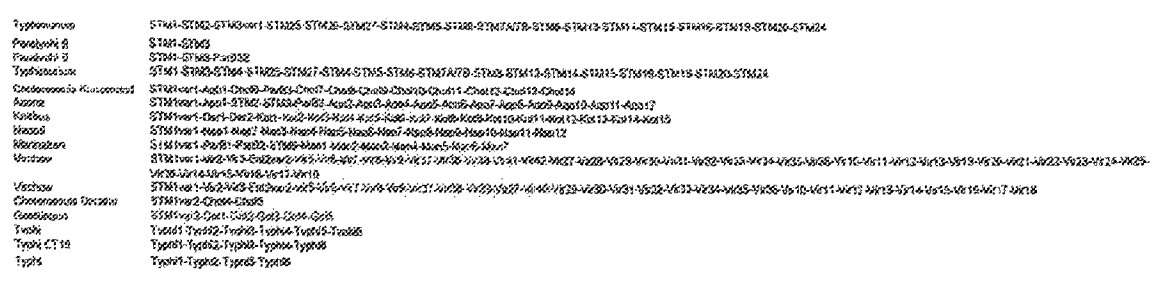

FIG. 3 indicates the variable-sequence (spacer) composition of the CRISPR1 (FIG. 3A) and CRISPR2 (FIG. 3B) loci at 154 strains of *Salmonella* of serotype Enteritidis. Also represented are the results of the conventional subtyping and epidemiological data (legend identical to that of FIG. 2).

Figure 4A:
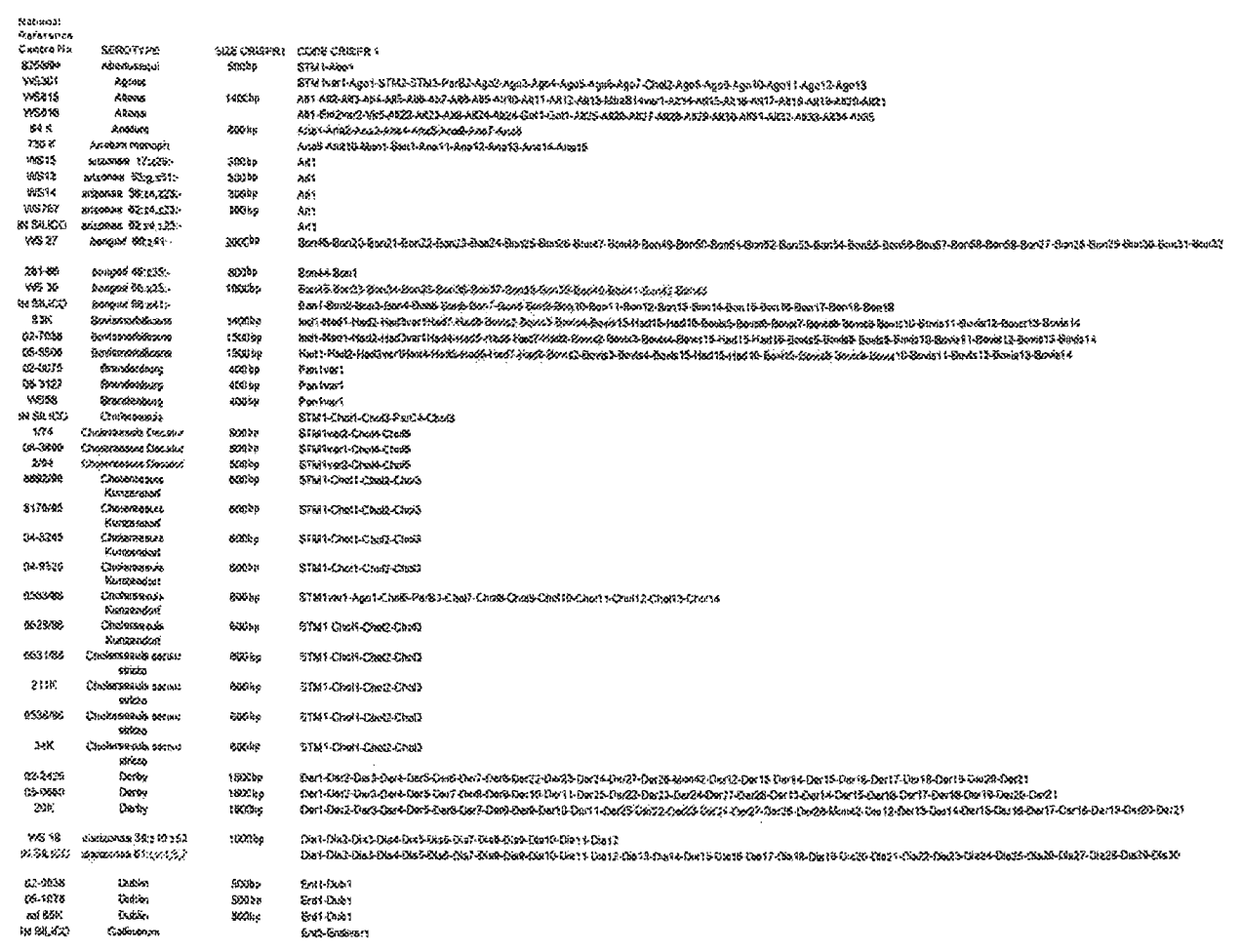
Figure 4A:
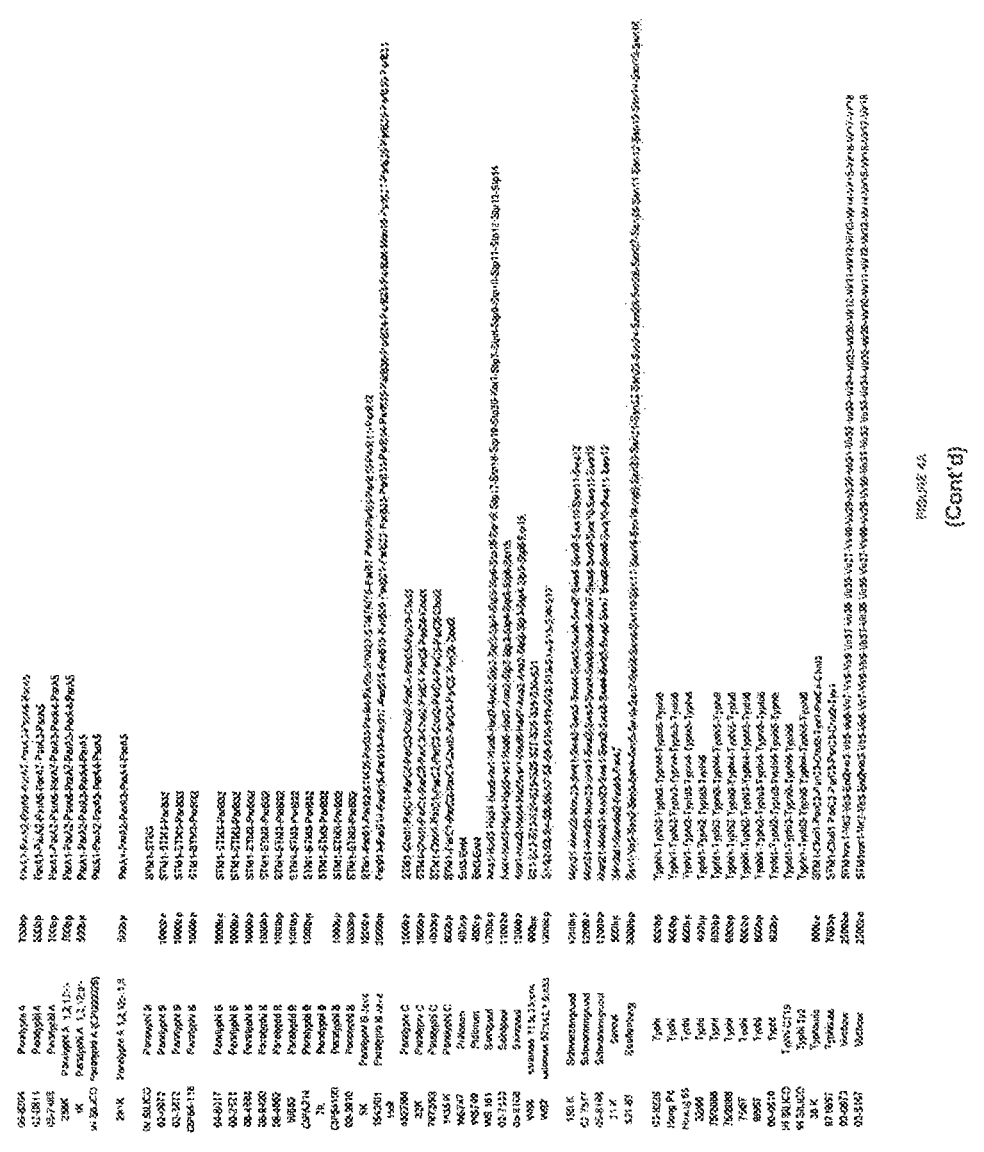
Figure 4B:
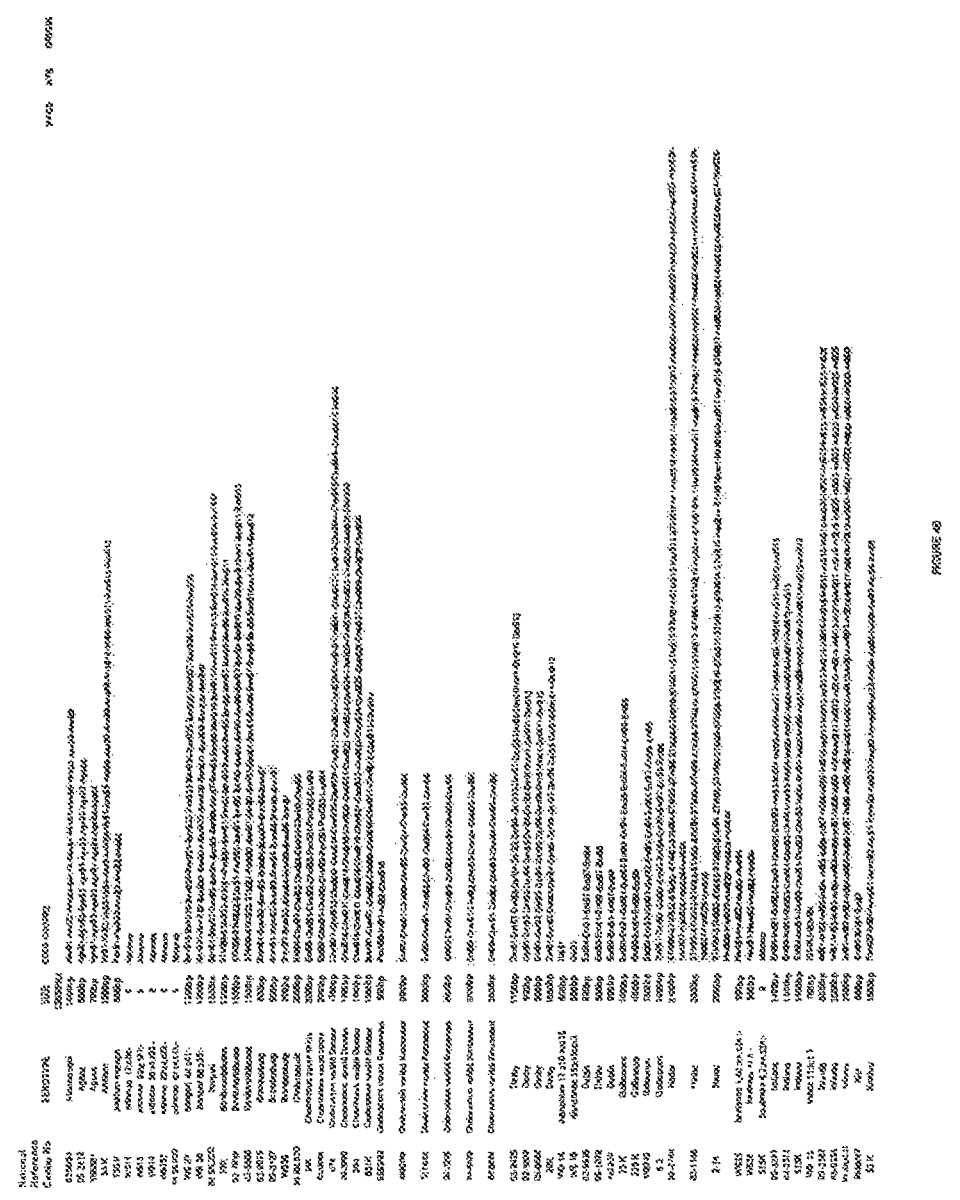
Figure 4:
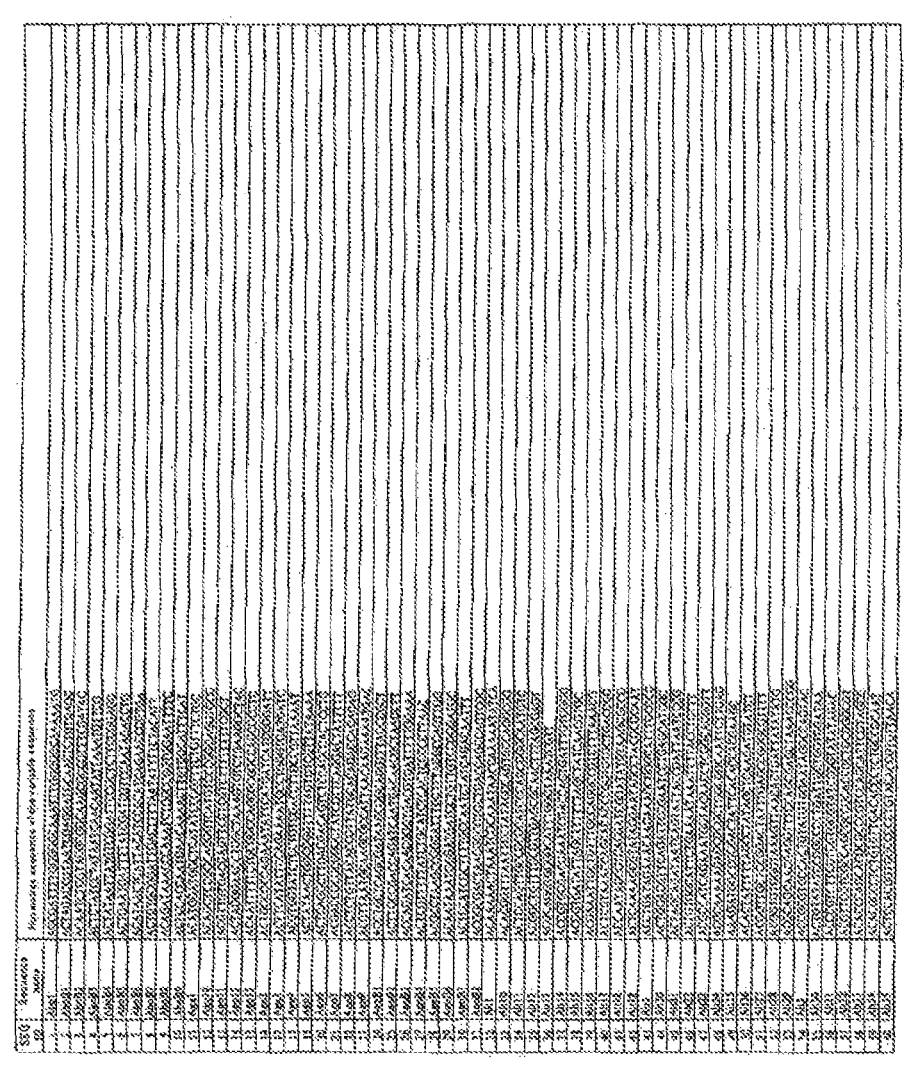

FIG. 4 indicates the variable-sequence (spacer) composition of the CRISPR1 (FIG. 4A) and CRISPR2 (FIG. 4B) loci, respectively of 95 and 85 strains of *Salmonella* belonging neither to the serotype Typhimurium nor to the serotype Enteritidis. Also represented are the results of the conventional subtyping and epidemiological data (sporadic cases, epidemic cases and origin of isolates).

Figure 5B:
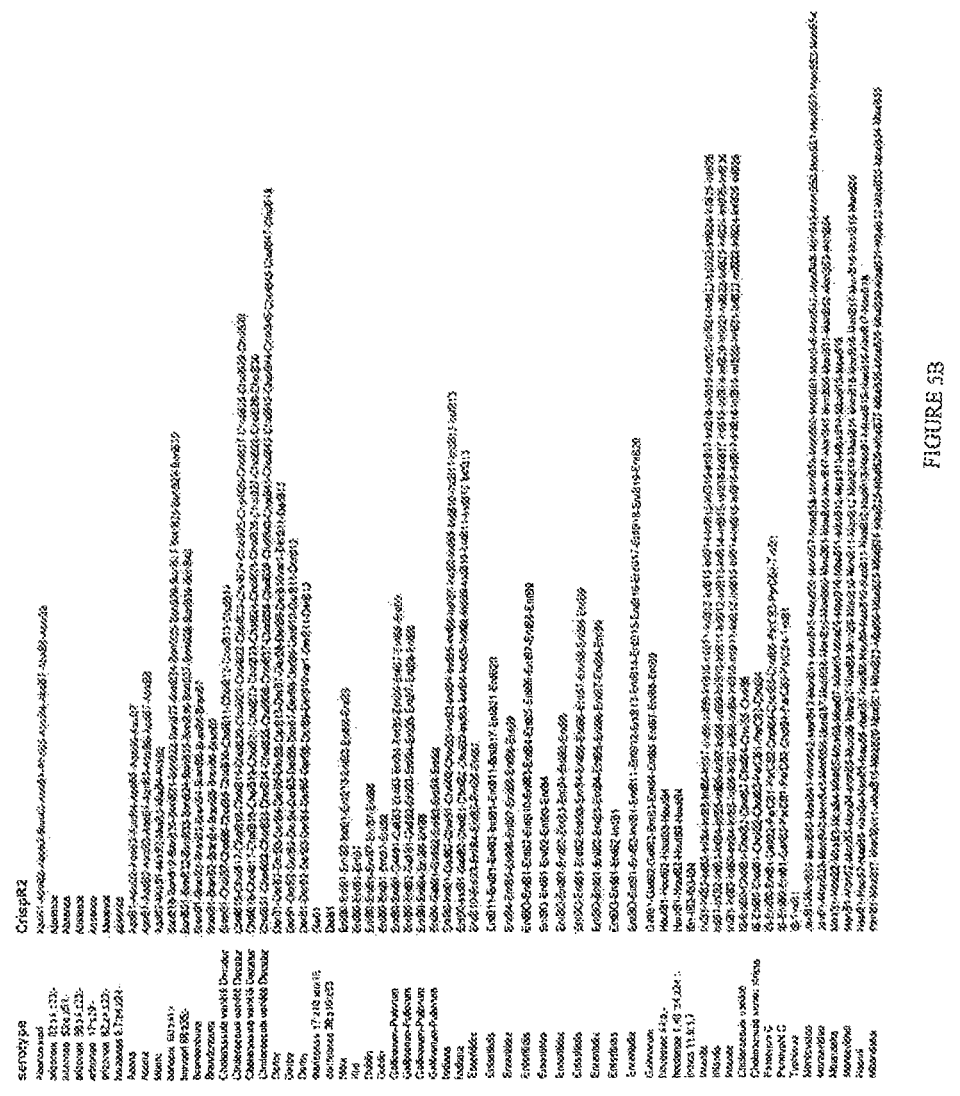
Figure 5B:
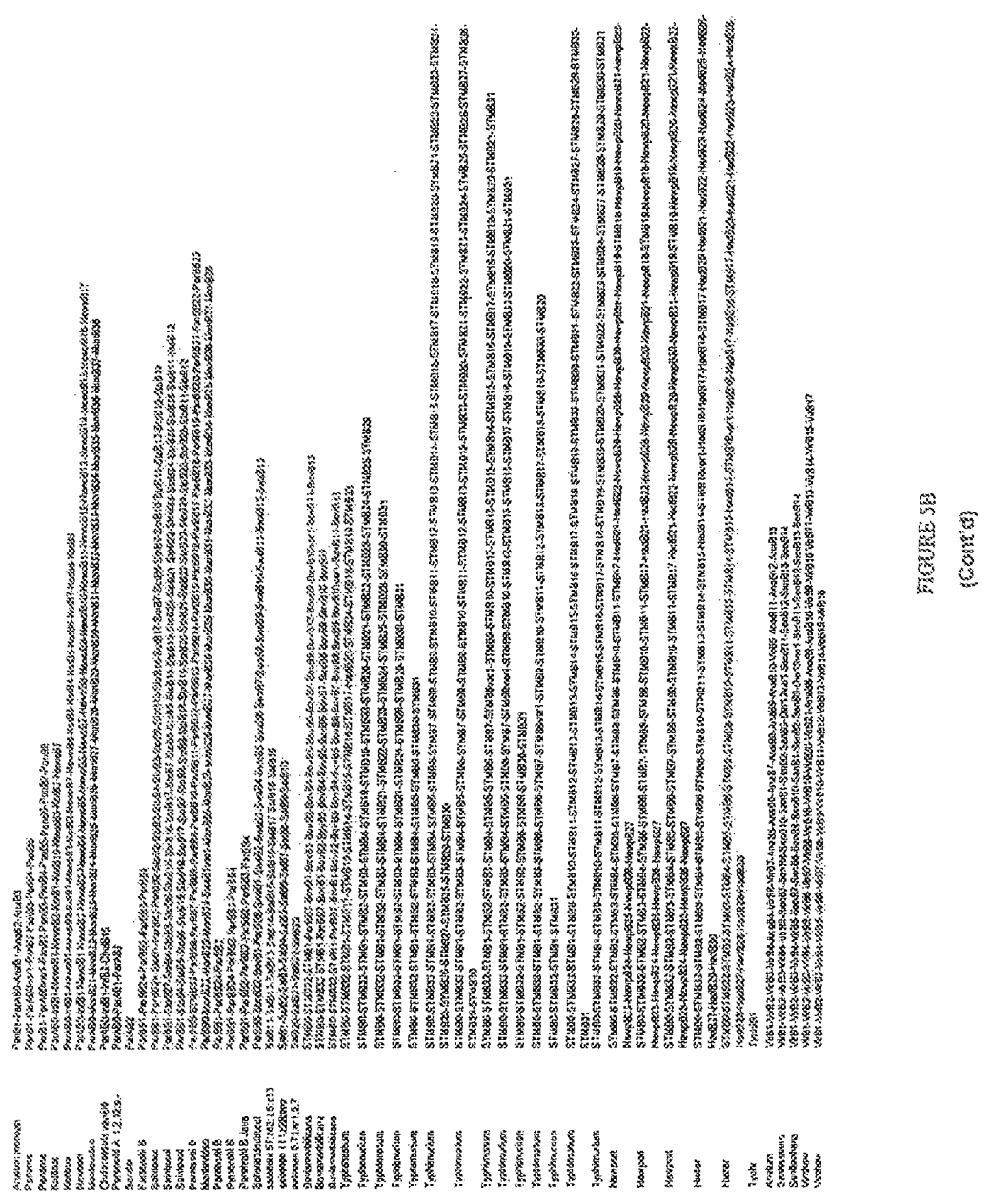

FIG. 5 shows the variation in the variable-sequence composition of CRISPR1 (FIG. 5A) and CRISPR2 (FIG. 5B) of some *Salmonella* strain serotypes.

FIGS. 6A and 6B represent the result of the sequencing (5'-3') of the CRISPR1 (SEQ ID NO: 2153) and CRISPR2 (SEQ ID NO: 2154) loci, respectively, of a *Salmonella* strain to be identified. The repeat sequences or direct repeats (DR) are shaded (the variable nucleotides within the DRs are represented in bold and italics). The variable sequences (spacers) are boxed in.

FIGS. 7A and 7B represent the result of the sequencing (5'-3') of the CRISPR1SEQ ID NO: 2155) and CRISPR2 (SEQ ID NO: 2156) loci, respectively, of a Salmonella strain to be identified (legend identical to that of FIG. 6).

Figure 9:
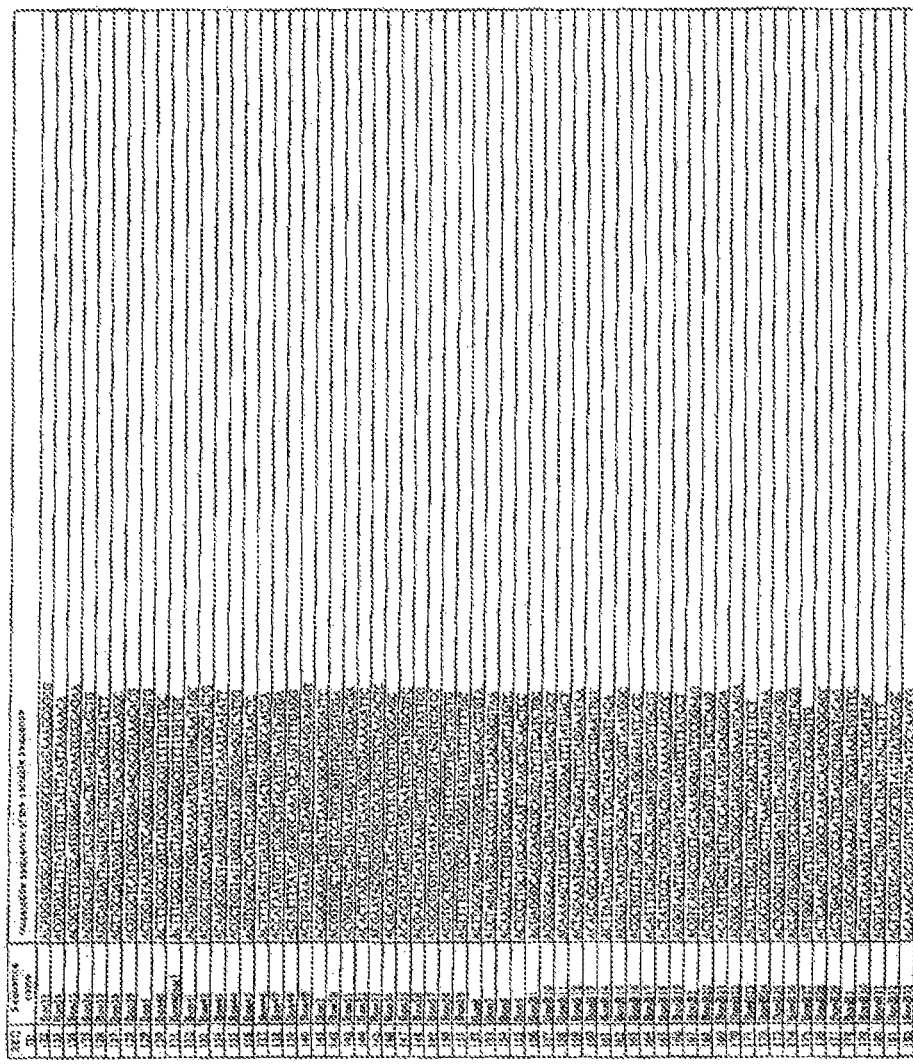
Figure 9:
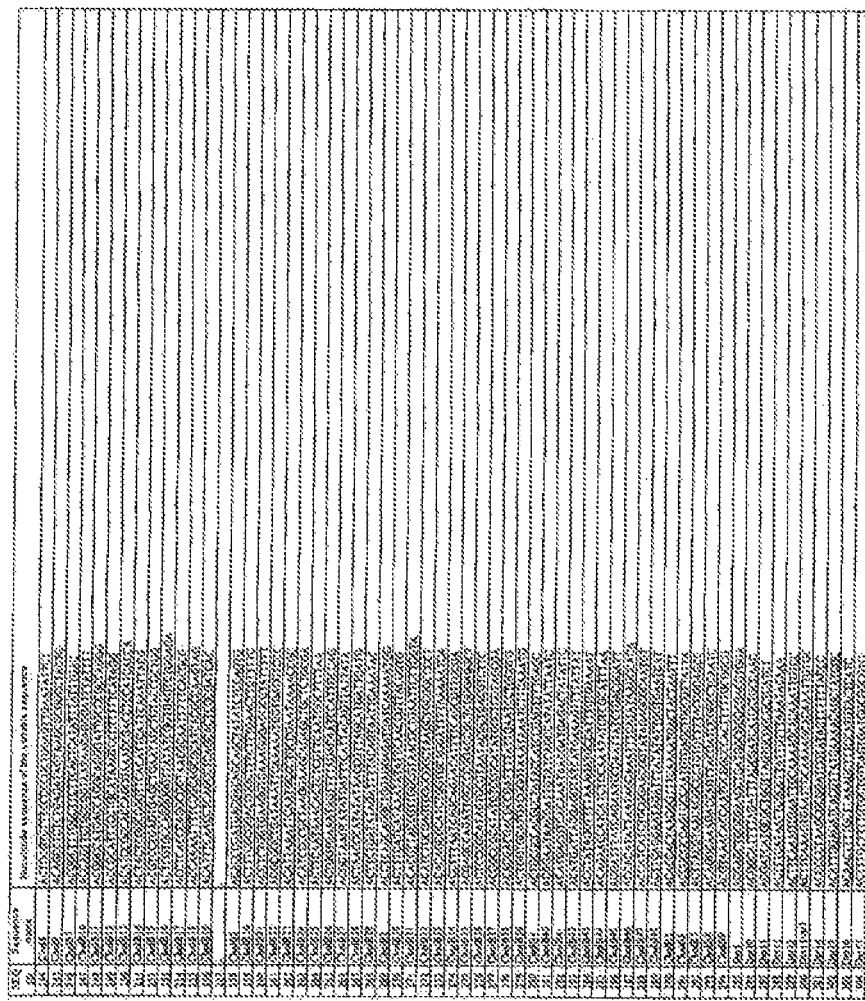

FIG. 9 indicates, for each variable sequence of the *Salmonella* CRISPR loci, the name which has been assigned thereto.

Figure 10A:
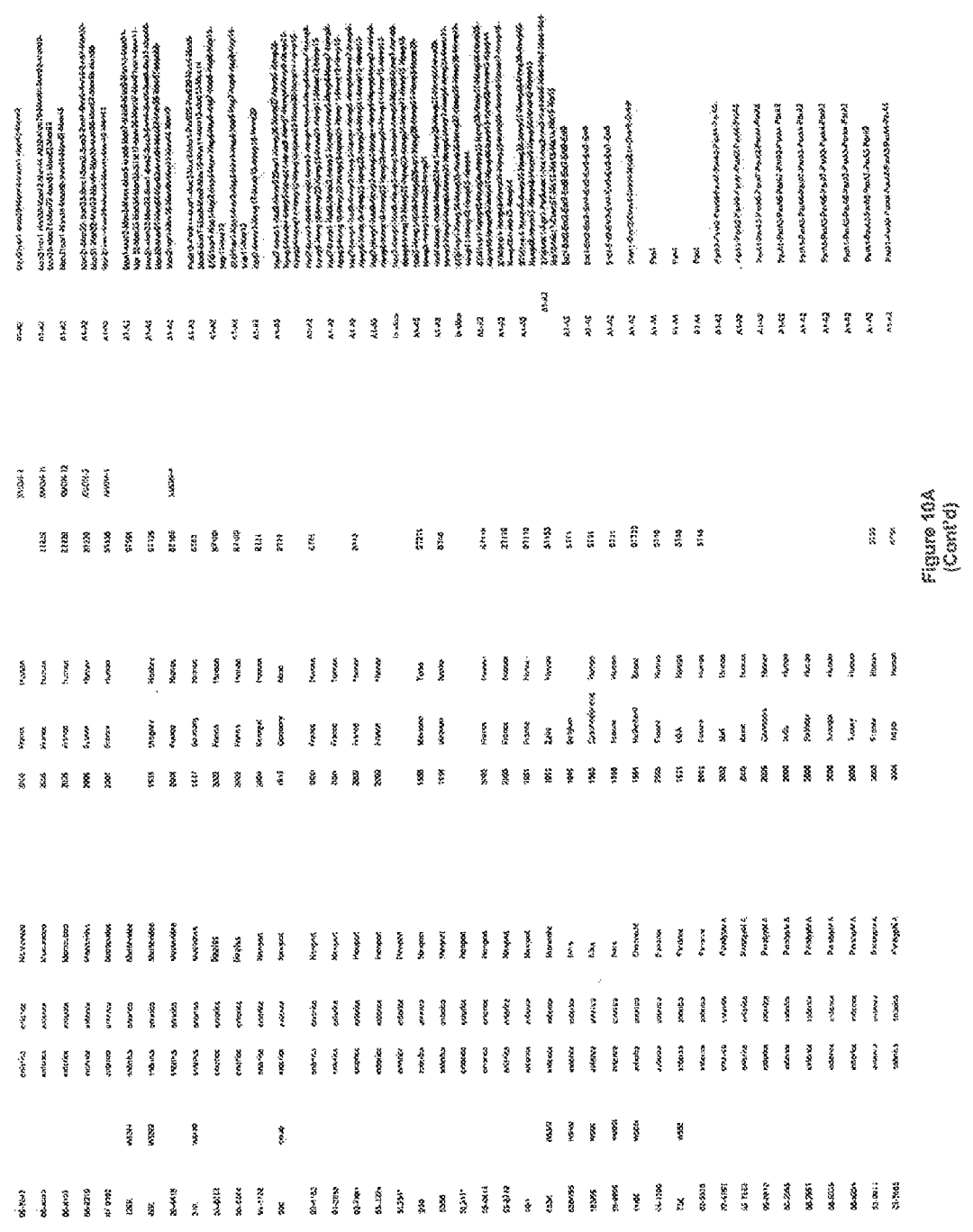
Figure 10B:
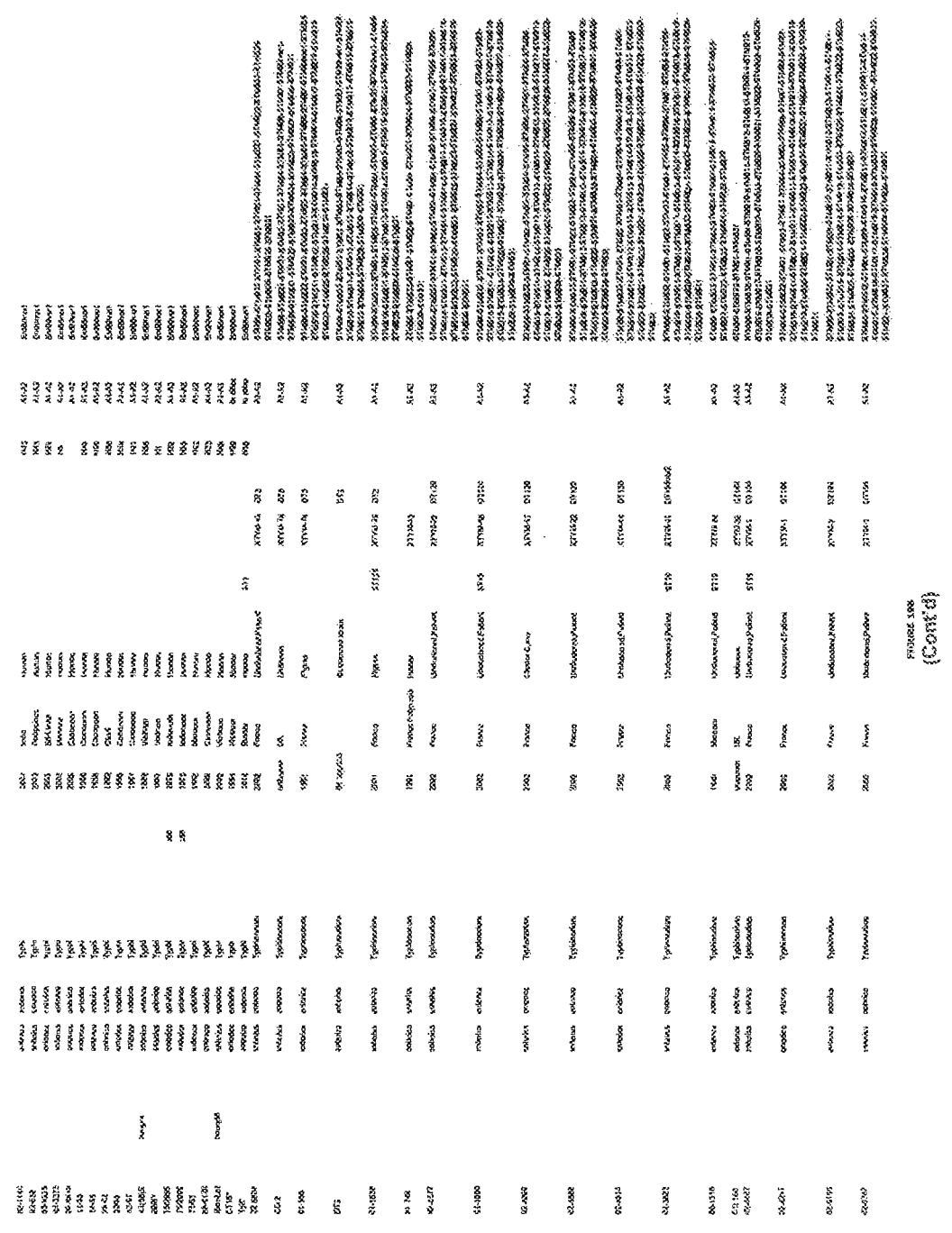

FIG. 10 indicates the variable-sequence (spacer) composition of the CRISPR1 (FIG. 10A) and CRISPR2 (FIG. 10B)

loci of 564 *Salmonella* strains. Also represented are the results of the conventional subtyping and epidemiological data (legend identical to that of FIG. 2). This comprises the variable-sequence composition of the CRISPR1 and CRISPR2 loci of types and subtypes of bacteria of the *Salmonella* genus, listed in FIGS. 2, 3 and 4.

It should be clearly understood that these examples are given only by way of illustration of the subject of the invention, of which they in no way constitute a limitation.

EXAMPLE 1

Forming of the Reference Base Listing the Composition of the Variable Sequences of the Two Loci CRISPR1 and CRISPR2 of *Salmonella*

1) Materials and Methods
1-1) Design of the Oligonucleotide Primers for Amplifying the CRISPR1 and/or CRISPR2 Loci in *Salmonella*
The primers, capable of amplifying the CRISPR1 and/or CRISPR2 loci of bacteria of the *Salmonella* genus, were designed on the basis of the genomic sequences of:
- *S. enterica* serotype Typhimurium LT2 (genome available under number AE008834 in the GenBank database, dated Aug. 9, 2005),
- *S. enterica* subsp. *enterica* serotype Choleraesuis strain SC-B67 (genome available under number AE017220 in the GenBank database, dated Jan. 11, 2006),
- *S. enterica* subsp. *enterica* serotype Paratyphi A strain ATCC 9150 (genome available under number CP000026 in the GenBank database, dated Apr. 8, 2005),
- *S. enterica* serotype Typhi strain CT18 (genome available under number AL627276 in the GenBank database, dated Nov. 14, 2006),
- *S. enterica* serotype Enteritidis PT4 NCTC 13349 (genome available on the Internet site of the Sanger Institute at the following address: http://www.sanger.ac.uk/Projects/Salmonella/),
- *S. bongori* 12419 ATCC 43975 (genome available on the Internet site of the Sanger Institute at the following address: http://www.sanger.ac.uk/Projects/*Salmonella*/, and at the following link: http://genome.wustl.edu/sub_genome_group.cgi?GROUP=3&SUB_GROUP=3),
- *S. enterica* subsp. *arizonae* serotype 62:z4,z23:– (genome available under number CP000880 in the GenBank database, dated Nov. 28, 2007), and *S. enterica* subsp. *diarizonae* serotype 61:1,v:1,5,7 (genomes available on the Internet at the following link: http://genome.wustl.edu/sub_genome_group.cgi?GROUP=3&SUB_GROUP=3).

Primers Capable of Amplifying the CRISPR1 Locus:
The position of the nucleotides is given with reference to the genome of *S. enterica* serotype Typhimurium LT2, available under number AE008834 in the GenBank database, dated Aug. 9, 2005, or of *S. enterica* serotype Typhi CT18, available under number AL627276 in the GenBank database, dated Nov. 14, 2006.

Forward primer called SALCRISP1-FB (=A1) (position of nucleotides: AE008834, 1109-1128):

(SEQ ID No.: 1326)
5'-GT(A/G)GT(A/G)CGGATAATGCTGCC-3'

Reverse primer called SALCRISP1-RB (=A2) (position of nucleotides: AE008834, 2878-2856):

(SEQ ID No.: 1327)
5'-CGTATTCCGGTAGAT(G/C/T)T(A/G/T)GATGG-3'

Primer called AriParaB-R (=A3) (reverse) (position of nucleotides: AE008834, 10289-10310): 5'-CTATTTTGG(A/G)CT(A/G)CCGAC(A/G)ATG-3'(SEQ ID No.: 1328)
This primer serves to amplify the *Salmonella* strains of the *arizonae* subspecies, the septicemic strains of serotype Paratyphi B, some strains of the *indica* subspecies, and the majority of the strains of serotype Mbandaka. These strains have a deletion downstream of the CRISPR1 locus.
Primer called BrPanCR1-R (=A4) (reverse) (position of nucleotides: AL627276, 232226-232206): 5'-GCAATCG-GAGCGATTGATGGC-3' (SEQ ID No.: 1329)
This primer serves to amplify the strains of serotypes Brandenburg and Panama. These strains have a deletion downstream of the CRISPR1 locus.
Primer called 50K (=A5) (reverse) (position of nucleotides: AL627276, 233322-233341): 5'-TCAACACTCTCT-TCACCCAG-3' (SEQ ID No: 2151).
This primer serves to amplify some of the serotypes Newport and Bardo.
Primer called HoutWS24R A6) (reverse) (position of nucleotides: AL627276 (233298-233017): 5'-TAACCAGC-CCTCTTCTGCCTG-3' (SEQ ID No.: 2152)
This primer serves to amplify certain strains of the *houtenae* subspecies.

Primers Capable of Amplifying the CRISPR2 Locus:
The position of the nucleotides is given with reference to the genome of *S. enterica* serotype Typhimurium LT2, available under number AE008834 or AE008835 in the GenBank database, dated Aug. 9, 2005.

Forward primer called SALCRISP2-FB (=B1) (position of nucleotides: AE008834, 18727-18751):

(SEQ ID No.: 1330)
5'-GAGCAATAC(C/T)(C/T)T(A/G)ATCGTTAACGCC-3'

(region missing in the *S. arizonae* subspecies).

Reverse primer 1 called SALCRISP2-RA (=B2) (position of nucleotides: AE008835, 931-906): 5'-GTTGC(A/G/T)ATA(G/T)GT(C/T)G(A/G)T(A/G)G(A/G)ATGT(A/G)G-3' (SEQ ID No.: 1331) (region missing in the *diarizonae* subspecies).

Reverse primer 2 called SALCRISP2-RB (=B3) (position of nucleotides: AE008835, 1205-1185):

(SEQ ID No.: 1332)
5'-CTGGCGGCTGTCTATGCAAAC-3'.

This sequence has, however, a mismatch in *S. enterica* serotype Typhimurium LT2 at position 1201.
1-2) Amplification of the CRISPR1 and CRISPR2 Loci
1-2-1) *Salmonella* Strains Used
The *Salmonella* strains analyzed come from the Centre National de Reference des *Salmonella* [National *Salmonella* Reference Center] and from the Centre Collaborateur OMS des *Salmonella* [WHO Collaborating Center for *Salmonella*], Emergent Pathogenic Bacteria Biodiversity Unit, 25 rue du Docteur Roux, 75724 Paris, Cedex 15. The strains are of human or animal or food origin, isolated from 1885 to 2005. They come from sporadic cases or were collected during investigated epidemics.

564 strains belonging to 86 serotypes of the 2 species and 6 subspecies of *Salmonella* were analyzed (between parentheses, the number of strains analyzed):

i) the species *S. enterica*
subspecies *enterica*:

serotypes Abony (1), Abortusequi (1), Aesch (1), Agona (12), Albany (1), Altona (2), Anatum (3), Arechavalata (1), Bardo (1), Berta (1), Bispebjerg (1), Blegdam (1), Bovismorbificans (3), Brandenburg (3), Chester (1), Choleraesuis variety Decatur (3), Choleraesuis (1), Choleraesuis variety Kunzendorf (9), Choleraesuis sensu stricto (2), Concord (1), Crossness (1), Derby (4), Dublin (6), Duesseldorf (1), Emek (2), Enteritidis (173), Fulica (1), Gallinarum variety Duisburg (1), Gallinarum variety Gallinarum (4), Gallinarum variety Pullorum (2), Goettingen (1). Gueuletapee (1), Hadar (5), Heidelberg (6), Hessarek (1), Indiana (3), Infantis (4), Itami (1), Javiana (4), Johannesburg (1), Kentucky (2), Kiel (3), Kottbus (2), Kundunchi (1), Lindenburg (1), Manhattan (8), Maracaibo (1), Mbandaka (2), Miami (1), Mississippi (1), Montevideo (12), Muenchen (1), Napoli (2), Newport (13), Niarembe (1), Nitra (3), Overvecht (1), Panama (3), Paratyphi A (14), Paratyphi B (35), Paratyphi C (4), Poona (1), Potsdam (1), Reading (1), Rosenberg (1), Rubislaw (1), Saintpaul (5), Sandiego (1), Schwarzengrund (5), Sendai (1), Senftenberg (3), Stourbridge (6), Tallahassee (1), Tennessee (1), Typhi (20), Typhimurium (104), Typhisuis (1), Urbana (1), Virchow (4), Weltevreden (2), Zaiman (1), subspecies *salamae*:
serotypes 11:1,z28:e,n,x (1), 57:z42:1,6:Rz53 (1), 6,7:1,w: 1,5,7 (1), subspecies *arizonae*:
serotypes 62:z4,z23:– (2), 53:g,z51:– (1), 56:z4,z23:– (1), 17:z29:– (1), subspecies *diarizonae*:
serotypes 38:z10:z53 (1), 61:1,v:1,5,7 (1), subspecies *houtenae*:
serotypes 6,7:z4,z24:– (1), 44:a:–(1), 1,40:z4,z24:– (1), subspecies *indica*:
serotypes 11:b:1,7 (1), 6,7:z41:1,7 (1);

ii) the species *bongori*
serotypes 60:z41:– (1), 66:z35:– (1), 48:z35:– (1), 66:z41:– (1).

1-2-2) Extraction of *Salmonella* DNA

The DNA was extracted using the Instagene Matrix kit (BioRad) or the Wizard kit (Proméga) by following the manufacturer's instructions.

1-2-3) Gene Amplification Reactions

The *Salmonella* CRISPR1 and CRISPR2 loci were amplified either separately (FIG. 1A) or during the same reaction (FIG. 1B), by polymerase chain reaction (PCR).

1-2-3-1) Separate Gene Amplification of the two Loci CRISPR1 and CRISPR2 a) Primers Used:

Primers used for amplifying the CRISPR1 locus by multiplex PCR:

SALCRISP1-FB (SEQ ID No.: 1326)
and

SALCRISP1-RB, (SEQ ID No.: 1327)

AriParaB-R, (SEQ ID No.: 1328)

BrPanCR1-R, (SEQ ID No.: 1329)

50K (SEQ ID No.: 2151)
and

HoutWS24R. (SEQ ID No.: 2152)

Primers used to amplify the CRISPR2 locus by multiplex PCR:

SALCRISP2-FB, (SEQ ID No.: 1330)

SALCRISP2-RA (SEQ ID No.: 1331)
and

SALCRISP2-RB. (SEQ ID No.: 1332)

b) Reaction Mix:
DNA, extracted according to the method above, diluted to 1/10: 2 µl
Primers: 10 pmol for each primer
Deoxynucleoside triphosphates: 100 µM
Taq DNA polymerase (Ampli Taq Gold, Roche): 0.85 U
10× buffer (Roche): 10%
$MgCl_2$ (Roche): 1.5 mM
DMSO (Sigma): 5%
Pure water of molecular biology quality qs: 50 µl c) Amplification Conditions for the Two Loci:
94° C., 10 min (one cycle)
94° C., 1 min; 59° C., 1 min; 72° C., 1 min 30 s (35 cycles)
72° C. 10 min (one cycle).

d) Electrophoretic Separation of the Amplification Products

Loading of the samples (per well): 5 µl of PCR amplification product with 1 µl of 6× loading buffer added (loading buffer: 0.25% bromophenol blue; 0.25% xylene cyanol; 30% glycerol).

Markers used: 100 by DNA ladder and 1 kb DNA ladder (Biolabs, New England).

Migration Conditions:
Loading onto a 1% agarose gel in 0.5×TBE [45 mM Tris HCl (pH 8); 45 mM boric acid; 10 mM EDTA (pH 8)].

Horizontal electrophoresis in 0.5×TBE at 100 V for 40 min.

Photograph taken after staining with ethidium bromide for 15 min.

1-2-3-2) Gene Amplification of the Two Loci CRISPR1 and CRISPR2 During the Same Amplification Reaction The gene amplification of the two loci CRISPR1 and CRISPR2 was carried out in a single step using the Expend Long Template PCR System (Roche).

a) Primers Used:

SALCRISP1-FB (SEQ ID No.: 1326)
and

SALCRISP2-RB (SEQ ID No.: 1332)

b) Reaction Mix:
DNA, extracted according to the method 2.5 µl above, pure:
Primers: 0.3 µM for each primer
Deoxynucleoside triphosphates: 0.5 mM
Taq DNA polymerase (provided with the kit): 3.75 U
10× buffer 2 (provided with the kit): 10%
Pure water of molecular biology quality qs: 50 µl c) Amplification Conditions for the Two Loci:
94° C., 2 min (one cycle)
94° C., 10 s; 58° C., 30 s; 68° C., 15 min (10 cycles)
94° C., 10 s; 58° C., 30 s; 68° C., 15 min, with an increase of 20 s in each cycle (20 cycles)
72° C., 7 min (one cycle)

d) Electrophoretic Separation of the Amplification Products

Loading of the samples (per well): 5 µl of PCR amplification product with 1 µl of 6× loading buffer added (loading buffer: 0.25% bromophenol blue; 0.25% xylene cyanol; 30% glycerol).

Markers used: Raoul™ (Qbiogene).

Migration Conditions:

Loading onto a 0.75% agarose gel in 0.5×TBE [45 mM Tris HCl (pH 8); 45 mM boric acid; 10 mM EDTA (pH 8)].

Horizontal electrophoresis in 0.5×TBE at 100 V for 3 hours.

Photograph taken after staining with ethidium bromide for 15 min.

2) Amplification Results 2-1) Amplification of the CRISPR1 Locus

The CRISPR1 locus of all the strains listed in FIG. 10 (with the exception of two *houtenae* strains, since they do not contain the CRISPR1 locus) was amplified using the primers SALCRISP1-FB (SEQ ID No.: 1326), SALCRISP1-RB (SEQ ID No.: 1327), AriParaB-R (SEQ ID No.: 1328), BrPanCR1-R (SEQ ID No.: 1329), 50K (SEQ ID No.: 2151) and HoutWS24R (SEQ ID No.: 2152); the size of the amplicons is between 400 by and 3000 bp.

2-2) Amplification of the CRISPR2 Locus

The CRISPR2 locus of all the strains listed in FIG. 10, with the exception of the strains below which do not possess the CRISPR2 locus, was amplified; the size of the amplicons is between 400 by and 3000 bp:

*S. enterica* subsp. *arizonae* serotypes 62:z4,z23:–, 53:g,z51:–, 56:z4,z23:–, 17:z29:–

*S. enterica* subsp. *diarizonae* serotypes 61:1,v:1,5,7

*S. enterica* subsp. *houtenae* serotypes 6,7:z4,z24:–

*S. enterica* subsp. *indica* serotypes 6,7:z41:1,7.

It is noted that the serotypes for which no amplification of the CRISPR2 locus was obtained could be amplified by the gene amplification method in a single step (cf. below).

2-3) Amplification of the CRISPR1 and CRISPR2 Loci During the Same Reaction

The CRISPR1 and CRISPR2 loci of the following serotypes were amplified simultaneously. The size of the amplicons is between 8 and 20 kb (for example, it is 20 kb for the region containing the two complete loci of *S. enterica* serotype Typhimurium LT2):

i S. enterica subsp. *enterica* of the serotypes Brandenburg and Panama

*S. enterica* subsp. *arizonae* serotypes 62:z4,z23 53:g,z51 56:z4.z23:–, 17:z29:–

*S. enterica* subsp. *diarizonae* serotypes 61:1,v:1,5,7

*S. enterica* subsp. *houtenae* serotypes 6,7:z4.z24:–, 44:a:–.

3) Sequencing of PCR Products

All the PCR amplification products were sequenced according to a method known to those skilled in the art, using the BigDye version 3.1 chemistry kit (Applied Biosystems, Foster City, Calif.) and an ABI 3700 instrument (Applied Biosystems).

4) Nucleotide Sequence Analysis and Variable-sequence Extraction

The nucleotide sequences were analyzed manually. The nucleotide sequences of the variable sequences (spacers) were extracted and also their order within the two CRISPR loci. A name was given to each variable sequence according to the serotype in which it was identified for the first time. All the variable sequences inventoried are listed in the sequence listing (sequences SEQ ID No.: 1 to 256, 258 to 614, 616 to 876, 878 to 1043, 1045 to 1147, 1149 to 1302, 1304 to 1325, 1333 to 2150) and in FIG. 9.

5) Correlation Between the Variable-sequence Composition and the Serotype and Subtype FIGS. 2, 3, 4, 5 and 10 (FIG. 10 also comprises the strains listed in FIGS. 2, 3, 4 and 5) give the variable-sequence (spacer) composition of the *Salmonella* strains analyzed. Also mentioned, in particular for the two main serotypes, Typhimurium and Enteritidis, are the results of the conventional subtyping (lysotype, antibiotype, pulse-field electrophoresis profile, MLVA type) and epidemiological data (sporadic cases, epidemic cases, etc.). FIG. 10 gives the various variable-sequence (spacer) compositions for all the *Salmonella* strains analyzed.

EXAMPLE 2

Analysis of the Variable-Sequence Composition of the CRISPR Loci of Three *Salmonella* Strains for the Purpose of Determining their Molecular Type and Subtype Three *Salmonella* strains were isolated from one sample. For each strain, the DNA was extracted according to the method described in example 1 and the CRISPR1 locus and/or the CRISPR2 locus was (were) amplified in a separate gene amplification as described in paragraph 1-2-3-1) above. The variable-sequence composition of each locus was determined by sequencing the DNA.

This composition can also be determined by hybridization of the amplified DNA fragments (labeled during the amplification, or after said amplification, with a radioactive or cold label, for example cyanin 3 or 5) with the sets of probes S1-1 to S44-2 using a DNA chip.

In order to determine the serotype and the subtype of each strain isolated, the composition of the CRISPR1 and/or CRISPR2 loci was compared to the reference base (FIGS. 10 and 9).

1) Analysis of the First Strain 02-1442

Figure 6:
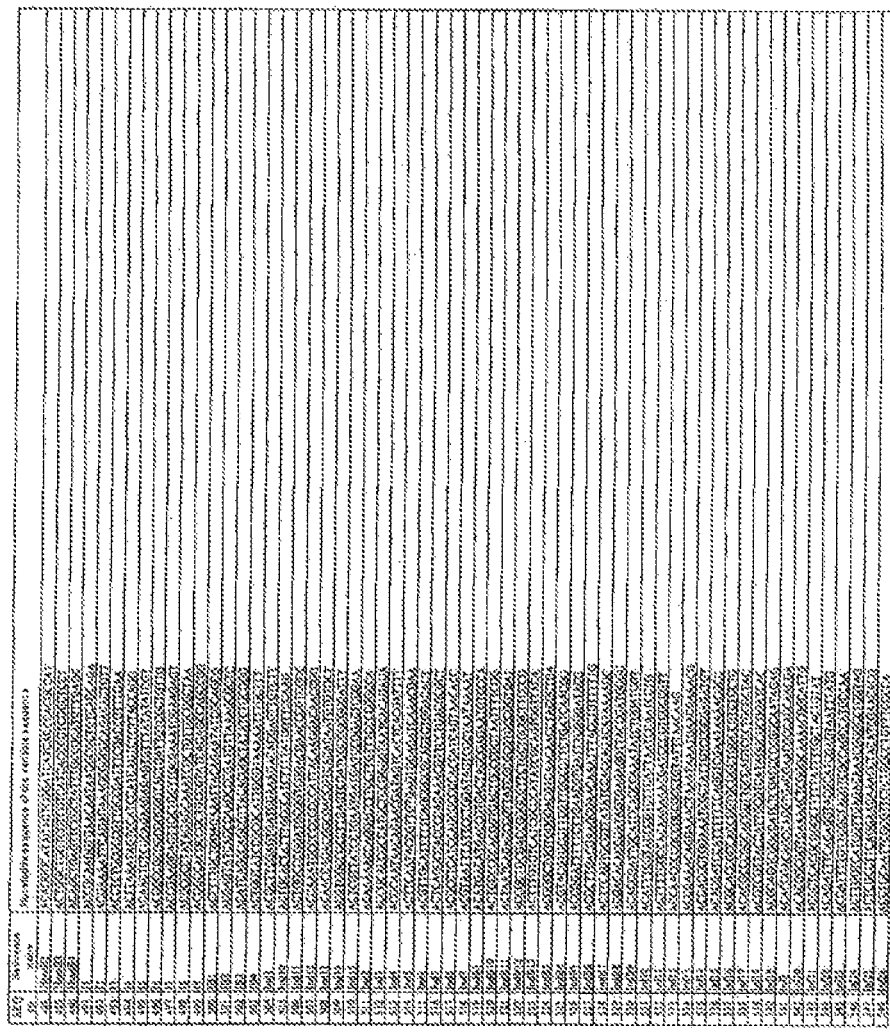
Figure 9:
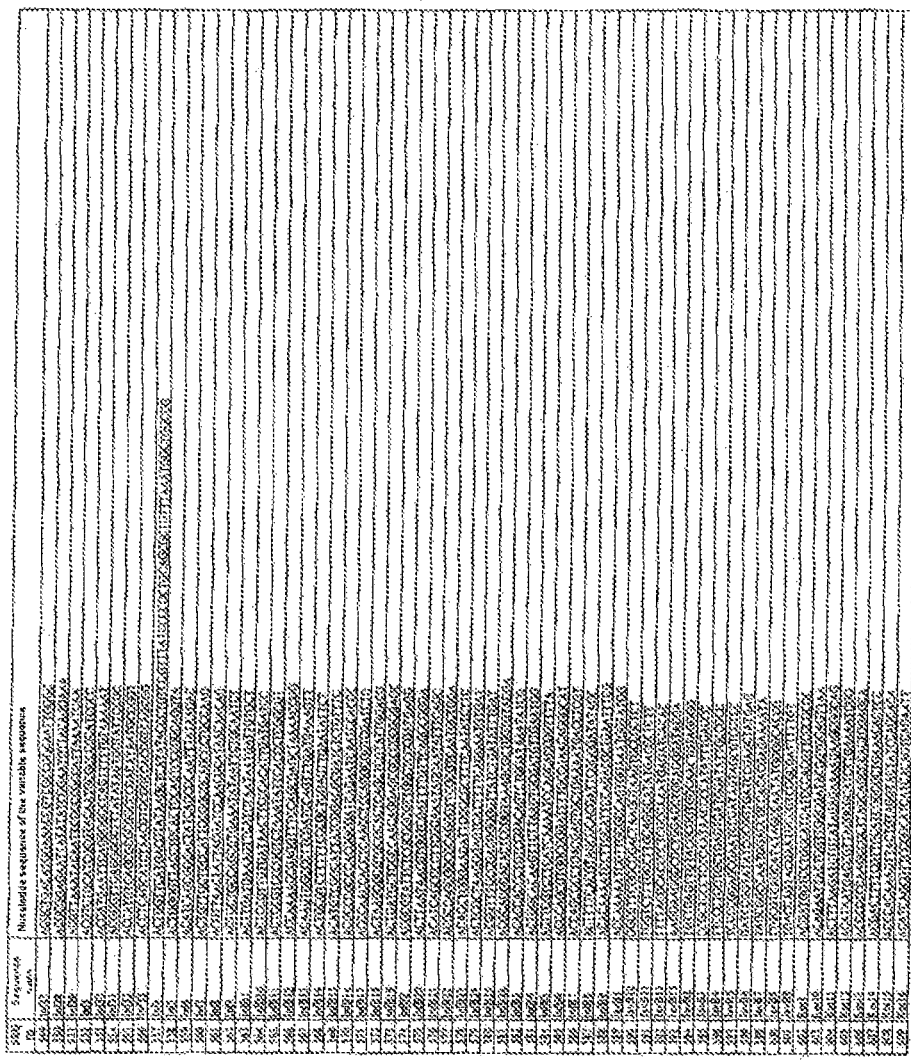
Figure 9:
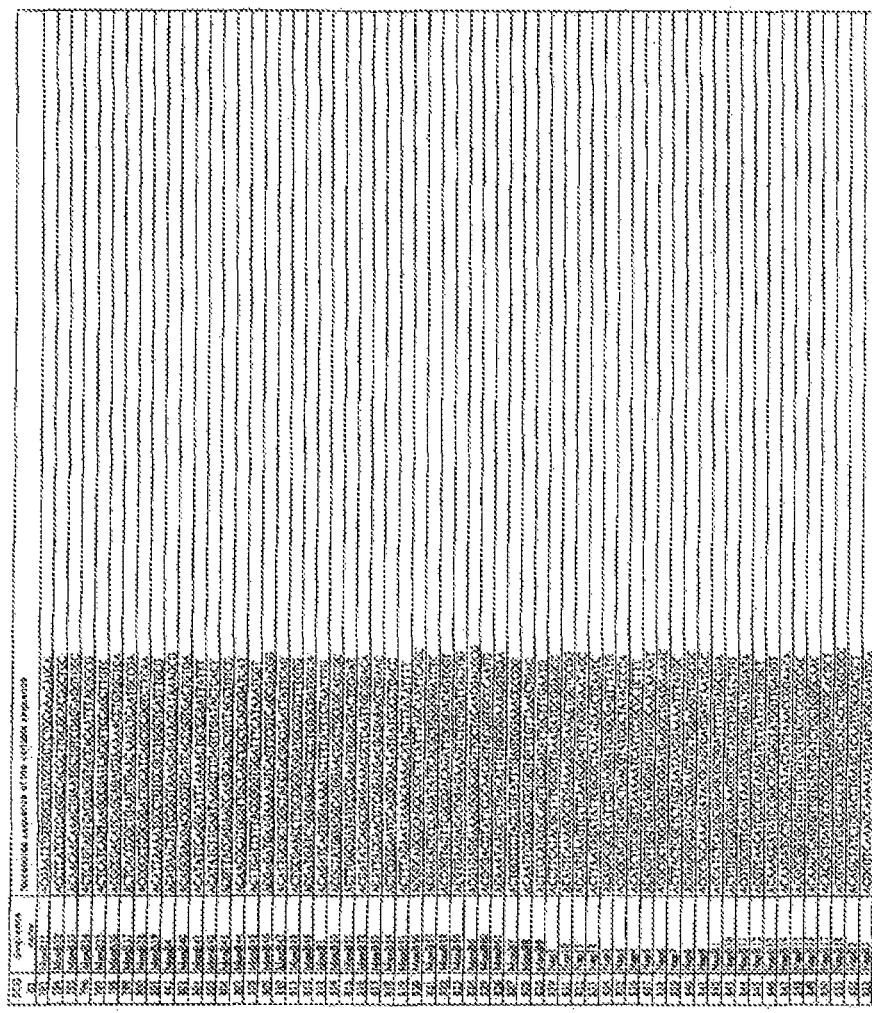
Figure 9:
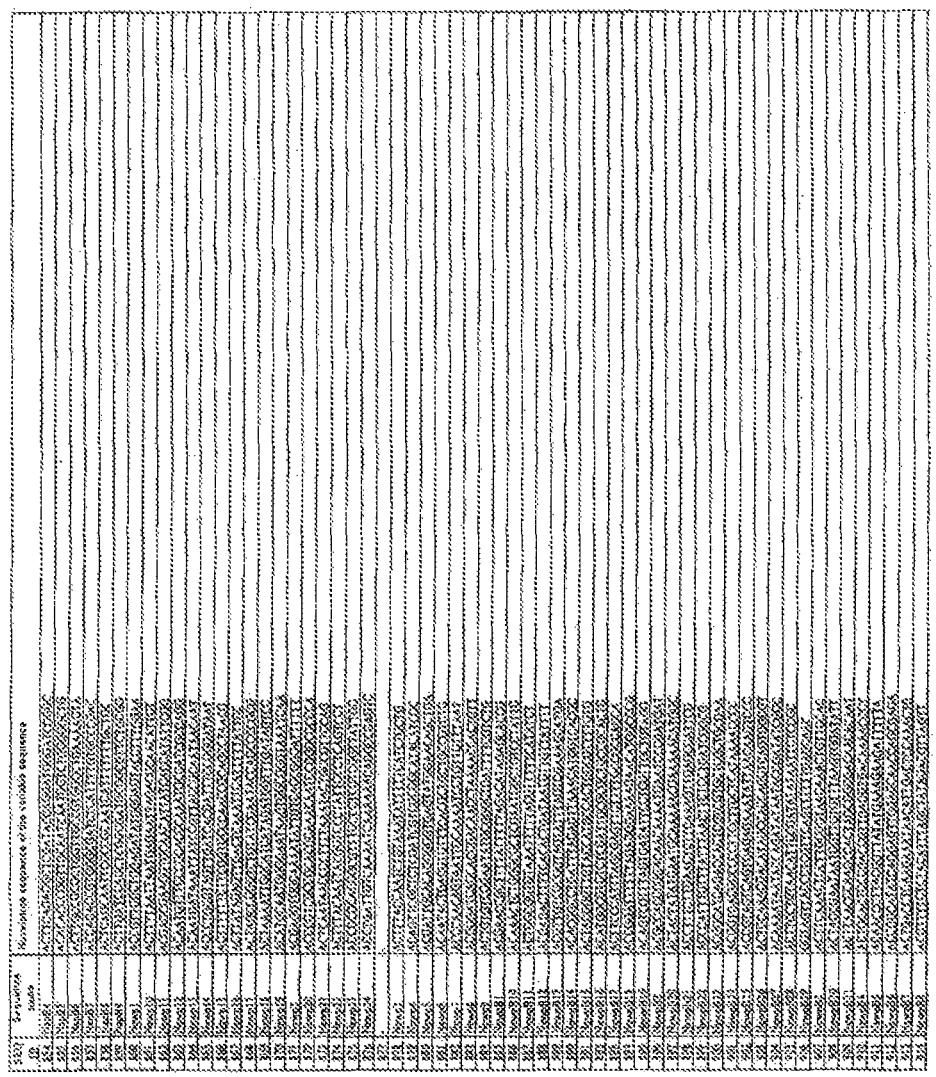
Figure 9:
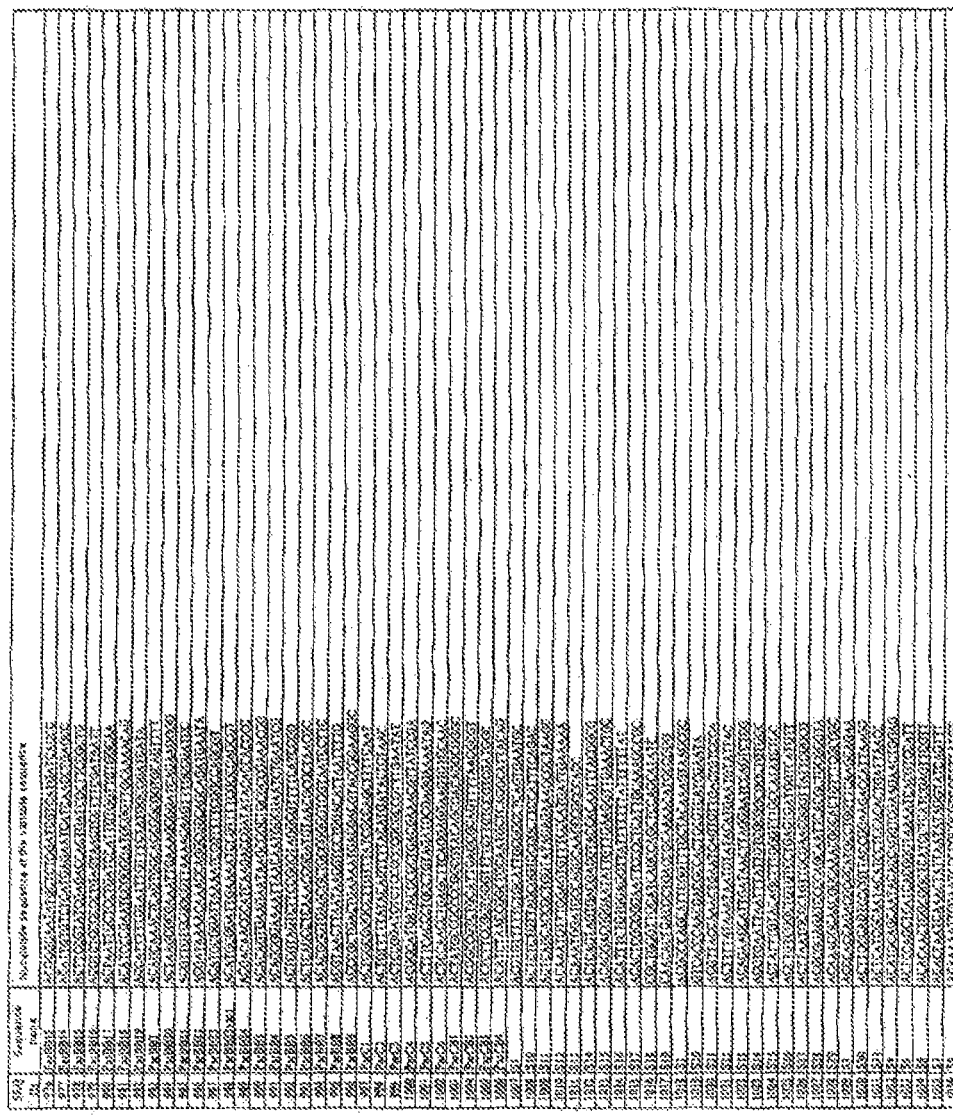
Figure 9:
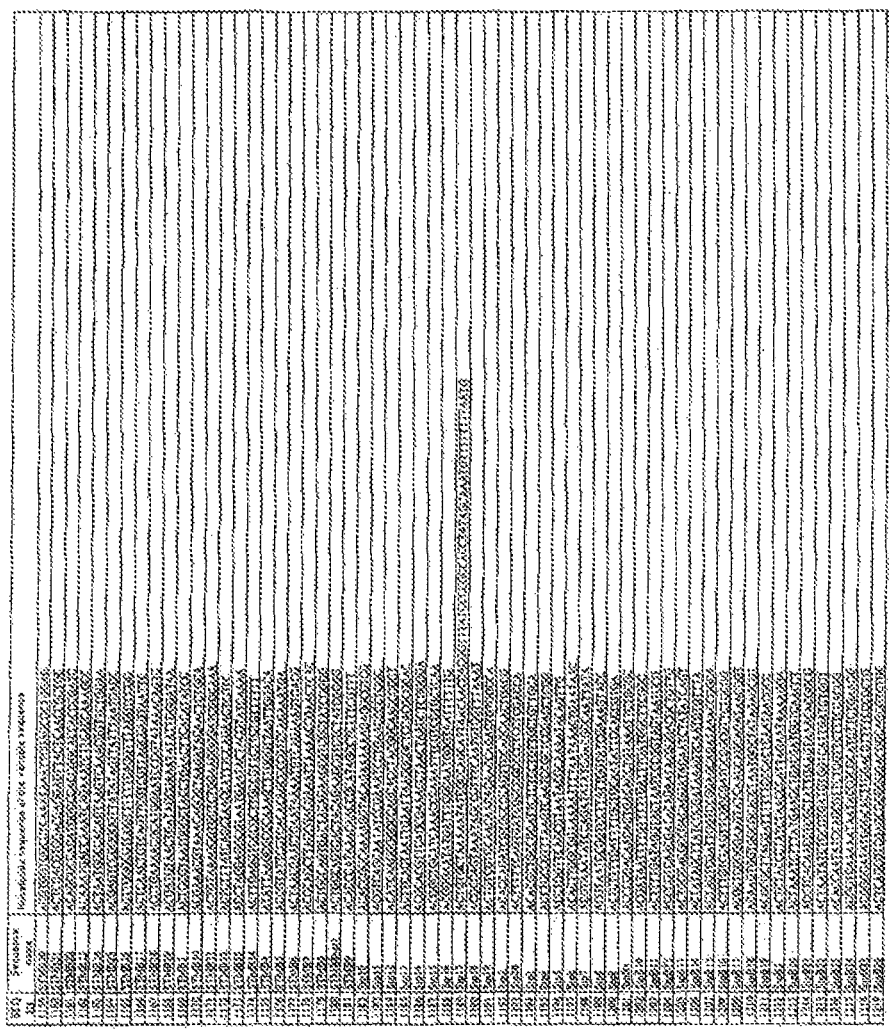
Figure 9:
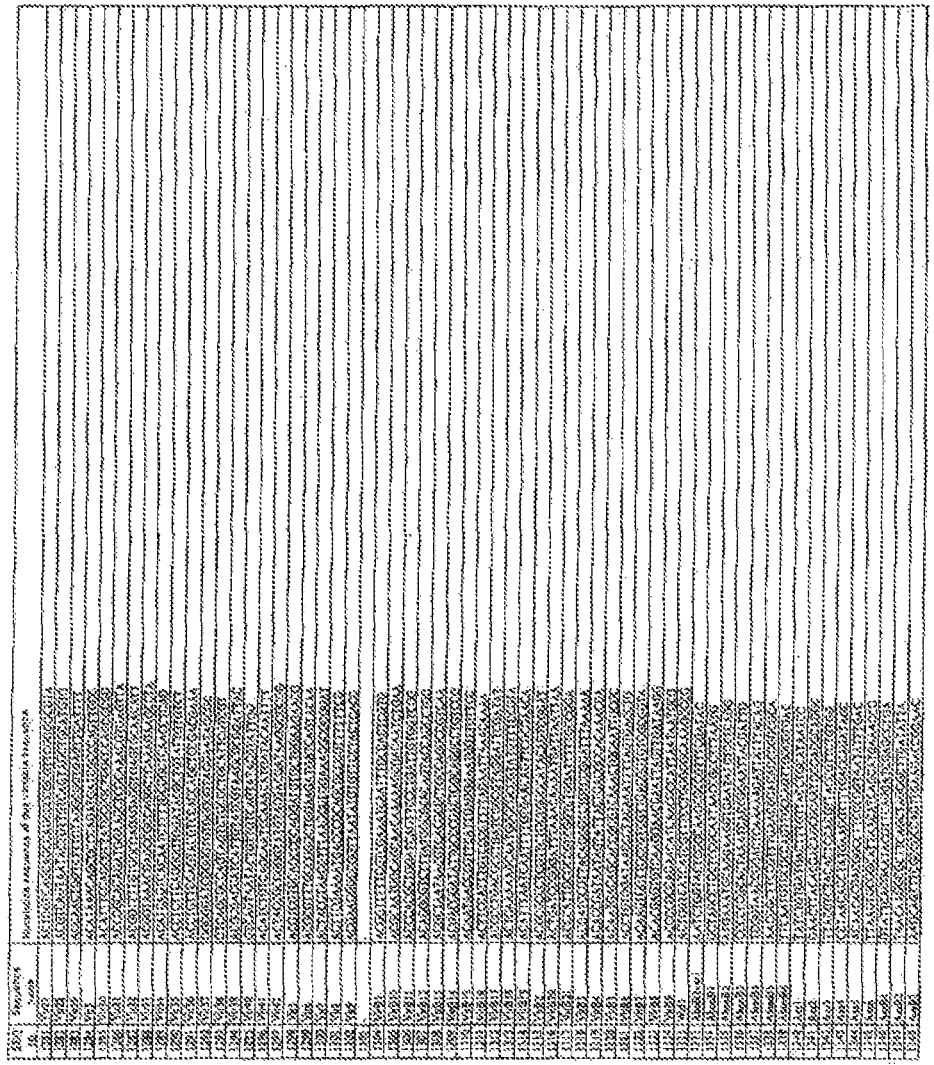
Figure 9:
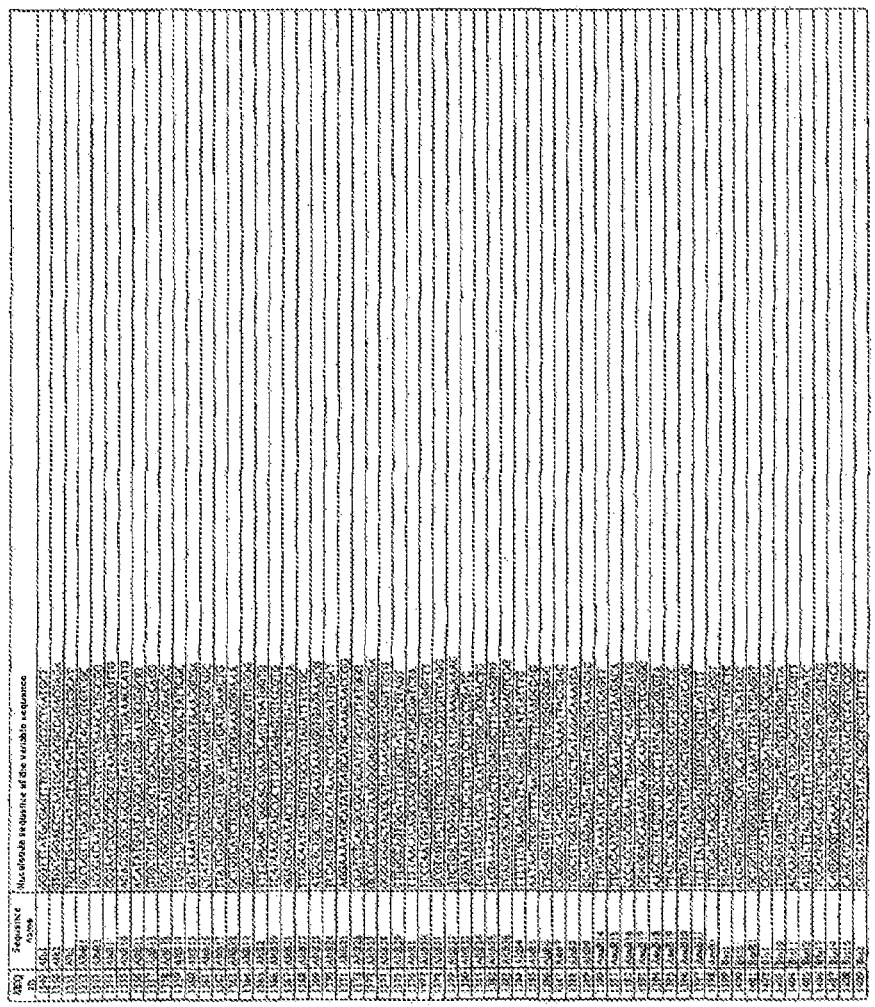
Figure 9:
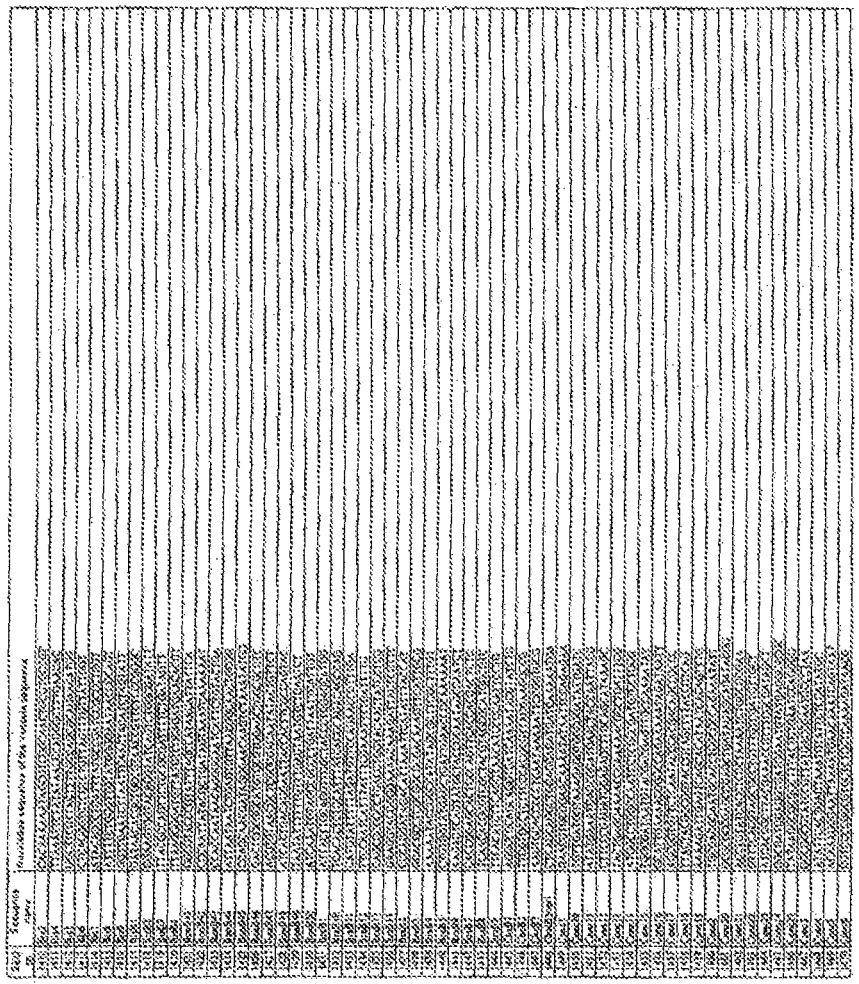
Figure 9:
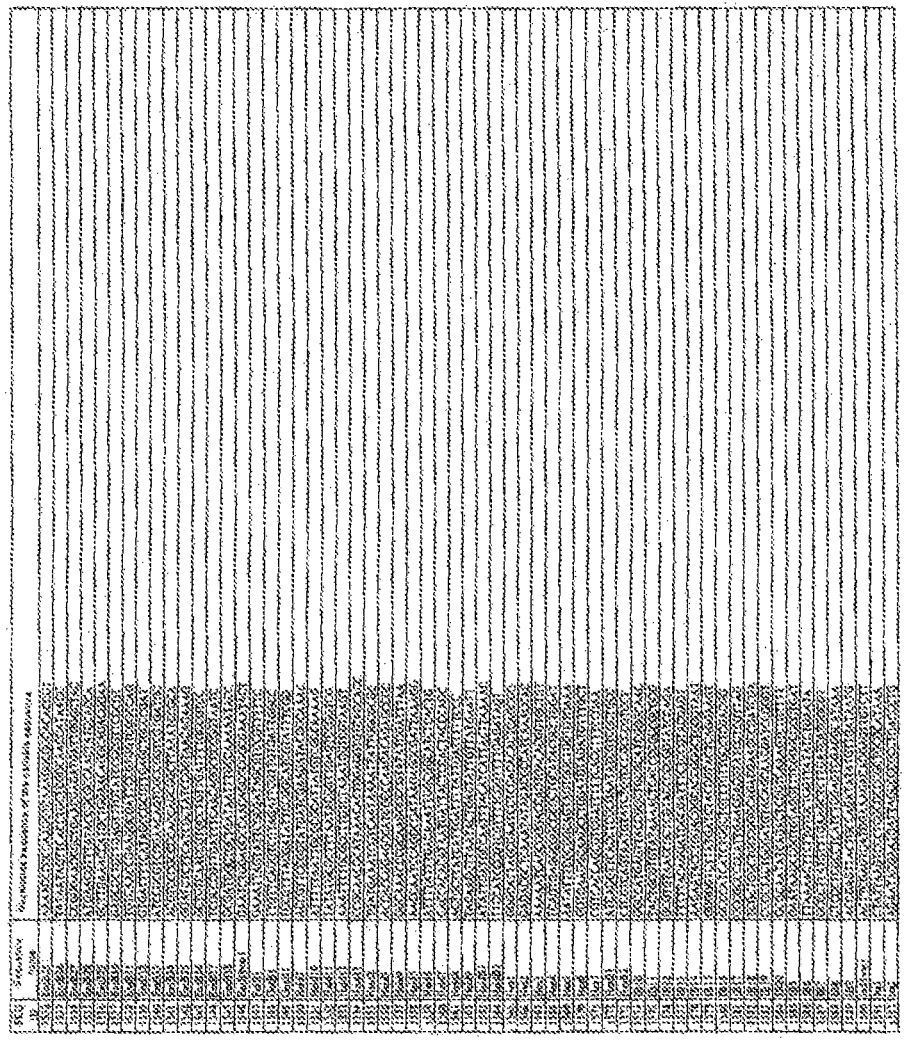
Figure 9:
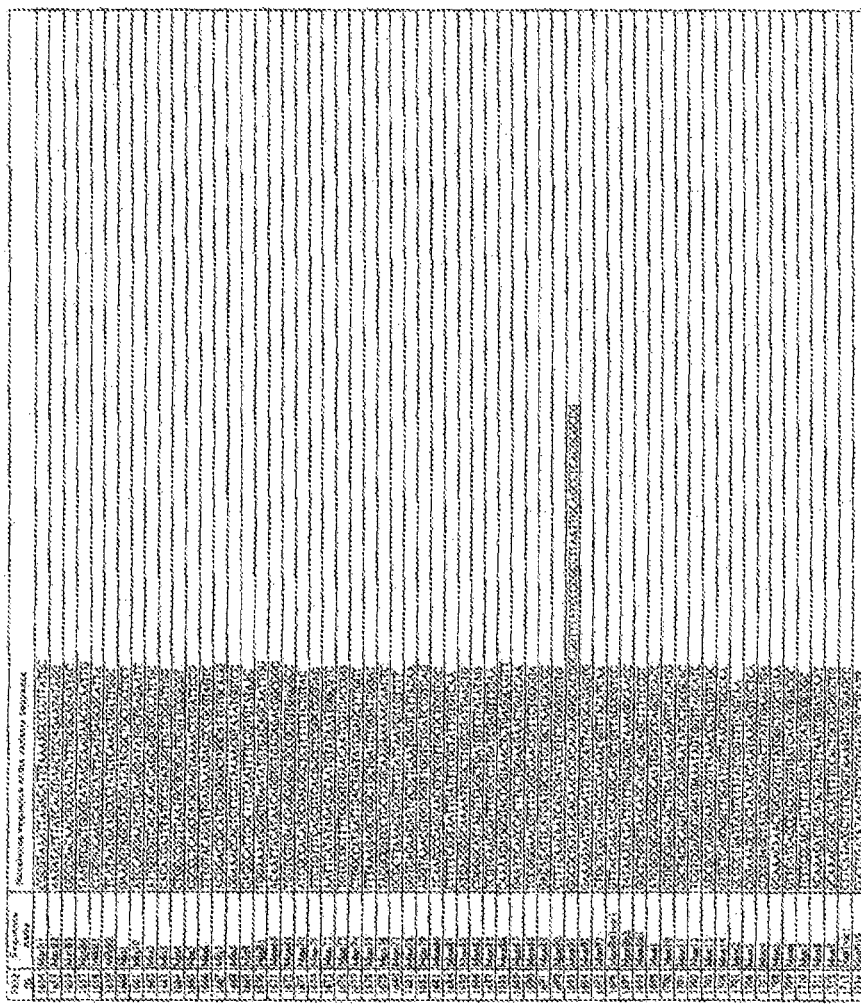
Figure 9:
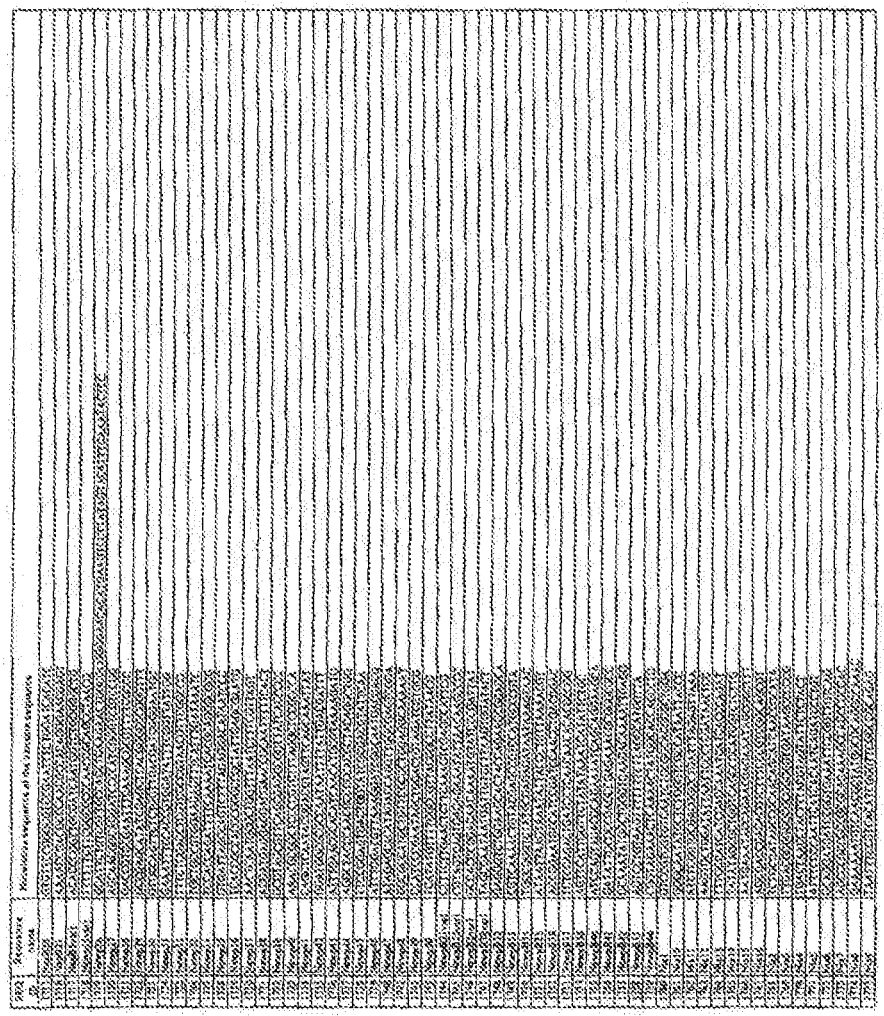
Figure 9:
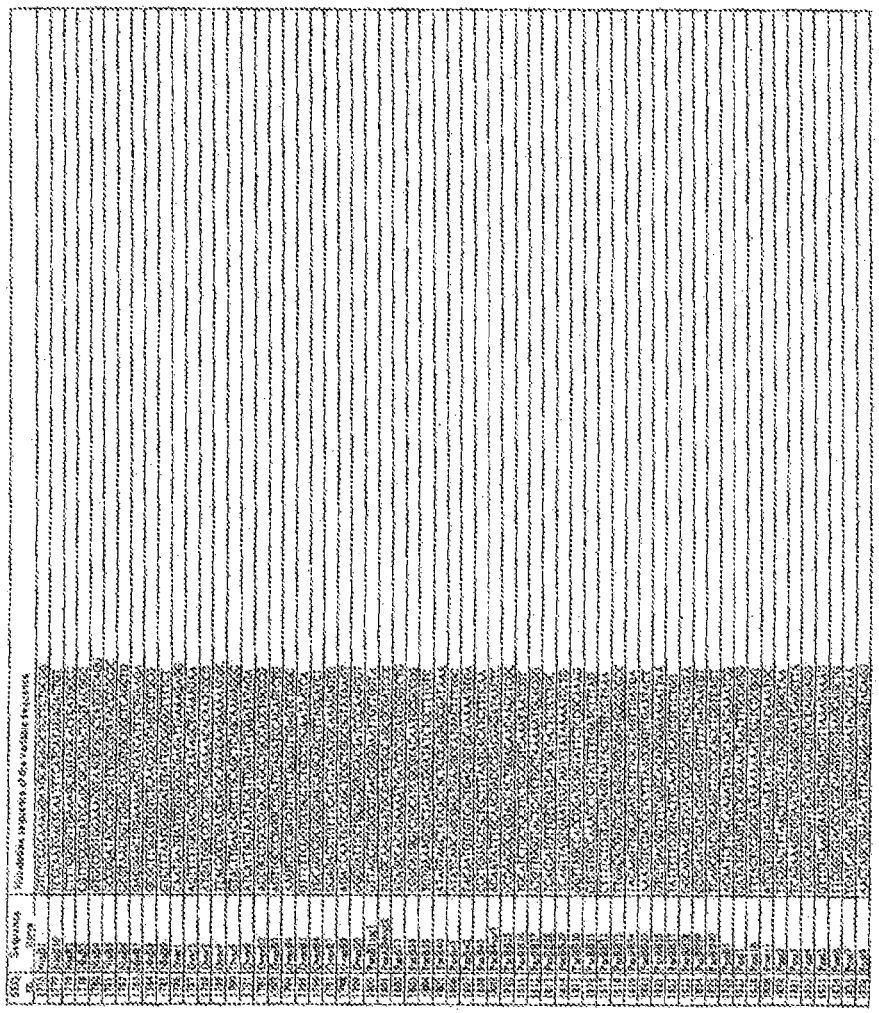

The sequence of the CRISPR1 locus (5' to 3') is represented in FIG. 6A.

The variable-sequence (spacer) composition of this sequence was determined as being the following: Ent1-Ent2-Ent3-Ent4-Ent5-Ent6-Ent7-Ent8, in which:

```
Ent1 (SEQ ID No.: 379):
ACTATTTATAAGCGTGTCATCTATGCAACCCAAC

Ent2 (SEQ ID No.: 380):
ACACCTGCCCGACCCAATAAGGGGGCCCTCGTGA

Ent3 (SEQ ID No.: 383):
ACGGCCGCTGGTCAAATTCCCAATCTGAGCAATC

Ent4 (SEQ ID No.: 384):
ACATAGCCCCGGCAGCGATAGCTAAACCAGTTCC

Ent5 (SEQ ID No.: 385):
ACGCCTCAAAATCTCTCGGTGAGATGTAAGCGTC

Ent6 (SEQ ID No.: 387):
ACACCAGTGGTCAGCGGCGGATGAATTTGCCCTG
```

Ent8 (SEQ ID No.: 389):
ACGAGAATGCTCATGCGCGTGAGCGCCATATATT

Ent8 (SEQ ID No.: 390):
ACAGGCGGACCGAAAAACCGTTTTCAGCCAACGT.

The sequence of the CRISPR2 locus (5' to 3') is represented in FIG. 6B.

The variable-sequence (spacer) composition of this sequence was determined as being the following: EntB0-EntB1-EntB2-EntB3-EntB4-EntB5-EntB6-EntB7-EntB8-EntB9,
in which:

```
EntB0 (SEQ ID No.: 392):
ACGGCTACACGCAAAAATTCCAGTCGTTGGCGCA

EntB1 (SEQ ID No.: 393):
ACCCGATTAAGATCCGCAGTCTGCATCAGTAACT

EntB2 (SEQ ID No.: 404):
ACCGATTCTACGGCAACAGGCCAGGCTGCGACCG

EntB3 (SEQ ID No.: 407):
ACATCAAACATGGAAACCCCTTTAATGAGAGCAA

EntB4 (SEQ ID No.: 408):
ACTCAGGAACGCGCGGCGGAAGAGCTTGGTGTTTG

EntB5 (SEQ ID No.: 409):
ACGCTGCCTTTCCCGGAGTTCCGGCCCCTAAATT

EntB6 (SEQ ID No.: 410):
ACTCATGCGCTATAAAAATCAGACTGTCACATGC

EntB7 (SEQ ID No.: 411):
ACTGATTATTGACGACAACAGCACAGACCGGCAG

EntB8 (SEQ ID No.: 412):
ACAATAATCGGCAATTTGTCCTGGACAGGCACGG

EntB9 (SEQ ID No.: 413):
ACGAATCTGGAGGCCAACAGCGCGGCGAAATCCT
```

After comparison, with the reference base (FIGS. 3 and 9), of the composition of the two CRISPR loci of the isolated bacterium, it was determined that the strain 02-1142 had the same spacer composition as the strains of *Salmonella* enterica serotype Enteritidis. This result was confirmed by serotyping.

2) Analysis of the Second Strain 02-4232

The sequence of the CRISPR1 locus (5' to 3') is represented in FIG. 7A.

The variable-sequence (spacer) composition of this sequence was determined as being the following: Ent1-Ent2var1-Ent3-Ent4-Ent5-Ent6-Ent7-Ent9-Ent8,
in which:

```
Ent1 (SEQ ID No.: 379):
ACTATTTATAAGCGTGTCATCTATGCAACCCAAC

Ent2var1 (SEQ ID No.: 381):
ACACCTGCCCGACCCAATAAGGAGGCCCTCGTGA

Ent3 (SEQ ID No.: 383):
ACGGCCGCTGGTCAAATTCCCAATCTGAGCAATC

Ent4 (SEQ ID No.: 384):
ACATAGCCCCGGCAGCGATAGCTAAACCAGTTCC

Ent5 (SEQ ID No.: 385):
ACGCCTCAAAATCTCTCGGTGAGATGTAAGCGTC

Ent6 (SEQ ID No.: 387):
ACACCAGTGGTCAGCGGCGGATGAATTTGCCCTG

Ent7 (SEQ ID No.: 389):
ACGAGAATGCTCATGCGCGTGAGCGCCATATATT

Ent9 (SEQ ID No.: 391):
ACCATGGCAATTTTACGGCGGACGTGCTCGCTCT

Ent8 (SEQ ID No.: 390):
ACAGGCGGACCGAAAAACCGTTTTCAGCCAACGT.
```

The sequence of the CRISPR2 locus (5' to 3') is represented in FIG. 7B.

The variable-sequence (spacer) composition of this sequence was determined as being the following: EntB0-EntB1-EntB2-EntB3-EntB4-EntB5-EntB6-EntB7-EntB8-EntB8-EntB9,
in which:

```
EntB0 (SEQ ID No.: 392):
ACGGCTACACGCAAAAATTCCAGTCGTTGGCGCA

EntB1 (SEQ ID No.: 393):
ACCCGATTAAGATCCGCAGTCTGCATCAGTAACT

EntB2 (SEQ ID No.: 404):
ACCGATTCTACGGCAACAGGCCAGGCTGCGACCG

EntB3 (SEQ ID No.: 407):
ACATCAAACATGGAAACCCCTTTAATGAGAGCAA

EntB4 (SEQ ID No.: 408):
ACTCAGGAACGCGCGGCGGAAGAGCTTGGTGTTTG

EntB5 (SEQ ID No.: 409):
ACGCTGCCTTTCCCGGAGTTCCGGCCCCTAAATT

EntB6 (SEQ ID No.: 410):
ACTCATGCGCTATAAAAATCAGACTGTCACATGC

EntB7 (SEQ ID No.: 411):
ACTGATTATTGACGACAACAGCACAGACCGGCAG

EntB8 (SEQ ID No.: 412):
ACAATAATCGGCAATTTGTCCTGGACAGGCACGG

EntB9 (SEQ ID No.: 413):
ACGAATCTGGAGGCCAACAGCGCGGCGAAATCCT.
```

After comparison, with the reference base (FIGS. 3 and 9), of the composition of the two CRISPR loci of the isolated bacterium, it was determined that the strain 02-4232 had the same spacer composition as the strains of *Salmonella enterica* serotype Enteritidis. This result was confirmed by serotyping. The spacer composition was different than the previous strain 02-1142, which was in agreement with the subtyping result obtained by phage typing (the strain 02-4232 being of lysotype PT4 and the strain 02-4232 of lysotype PT8).

3) Analysis of the Third Strain 02-1941

Figure 8:
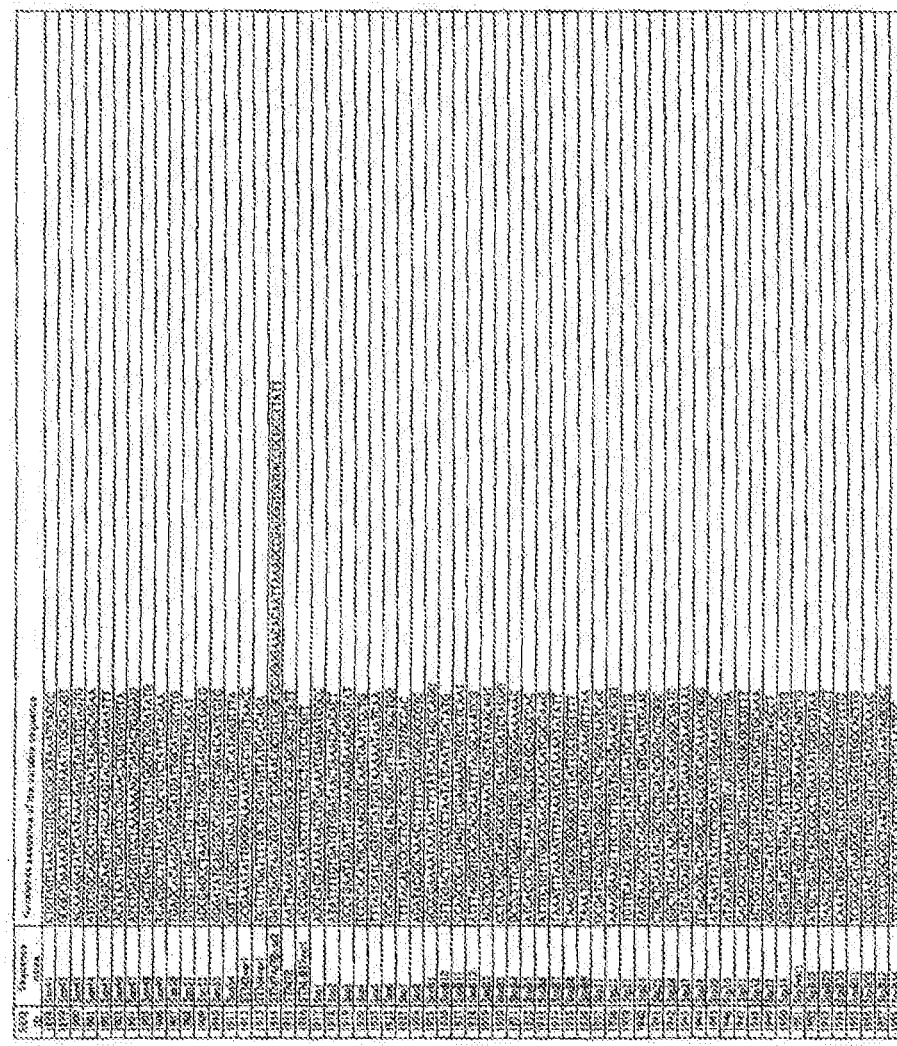
FIG. 8 represents the result of the sequencing (5'-3') of the CRISPR1 (SEQ ID NO: 2157) locus of a Salmonella strain to be identified (legend identical to that of FIG. 6).
Figure 9:
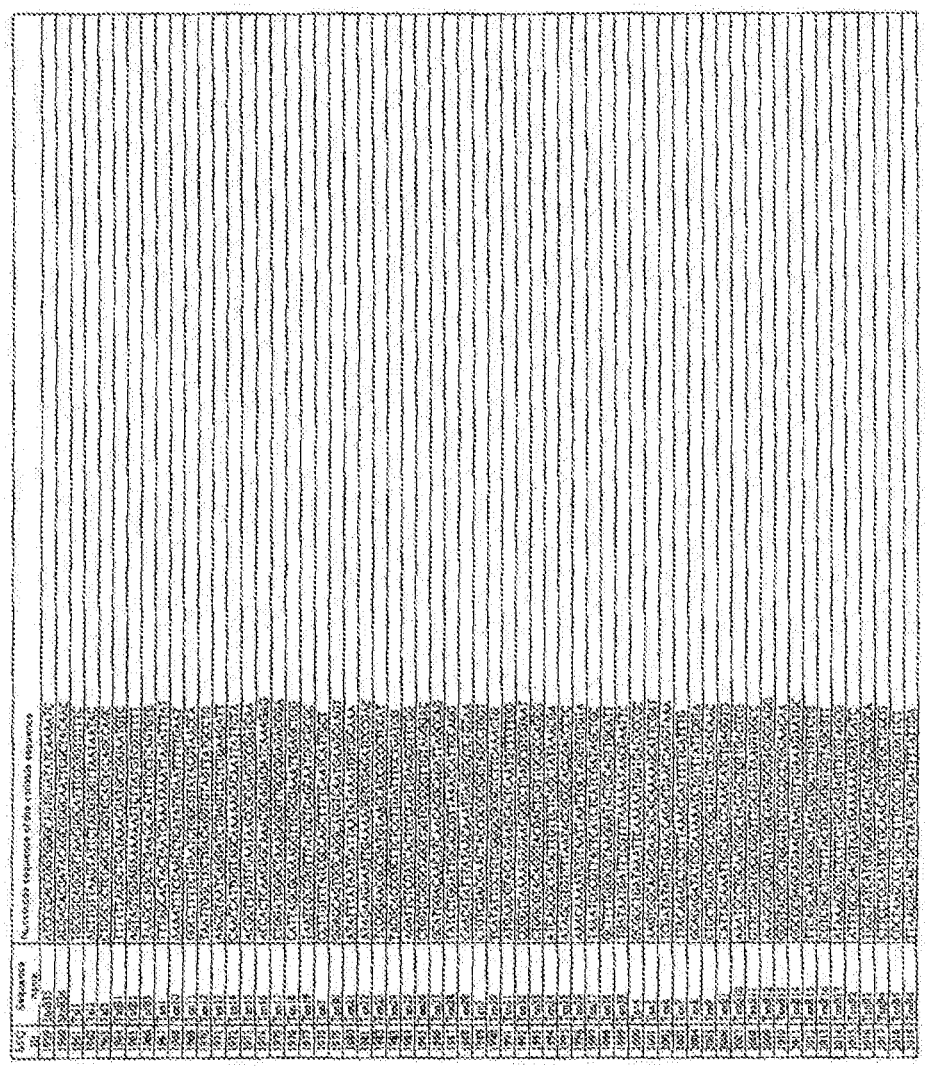
Figure 8:
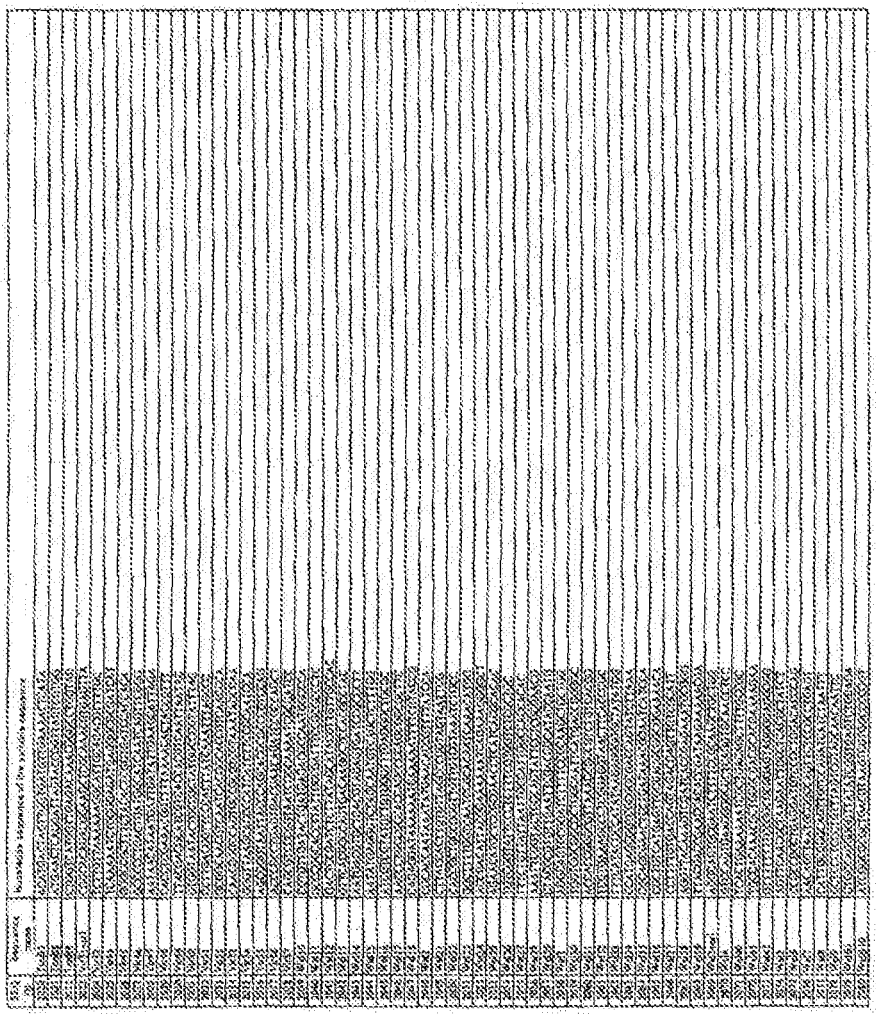
Figure 9:
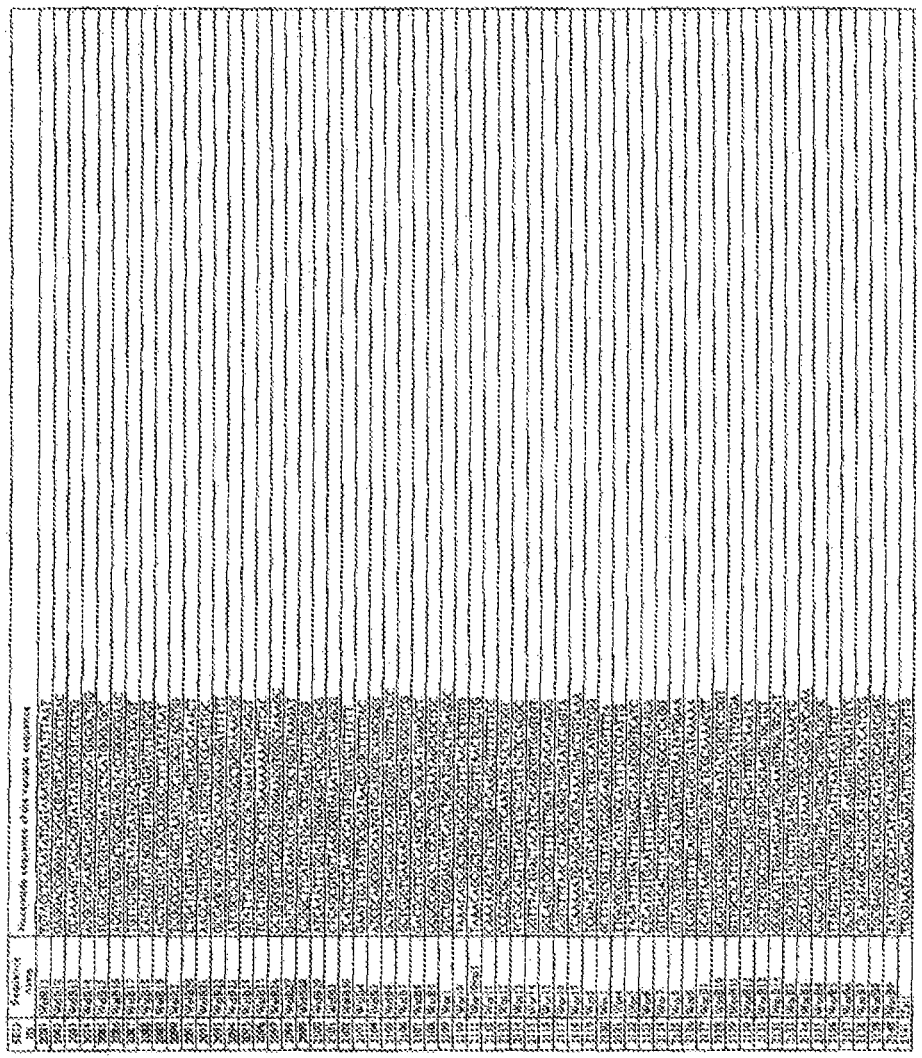
Figure 9:
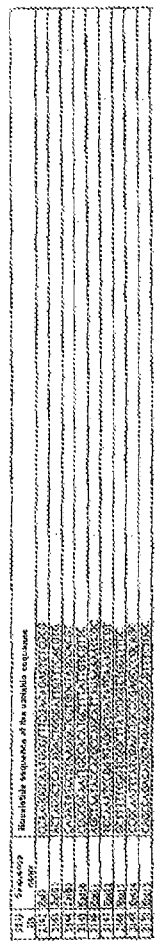
Figure 8E:
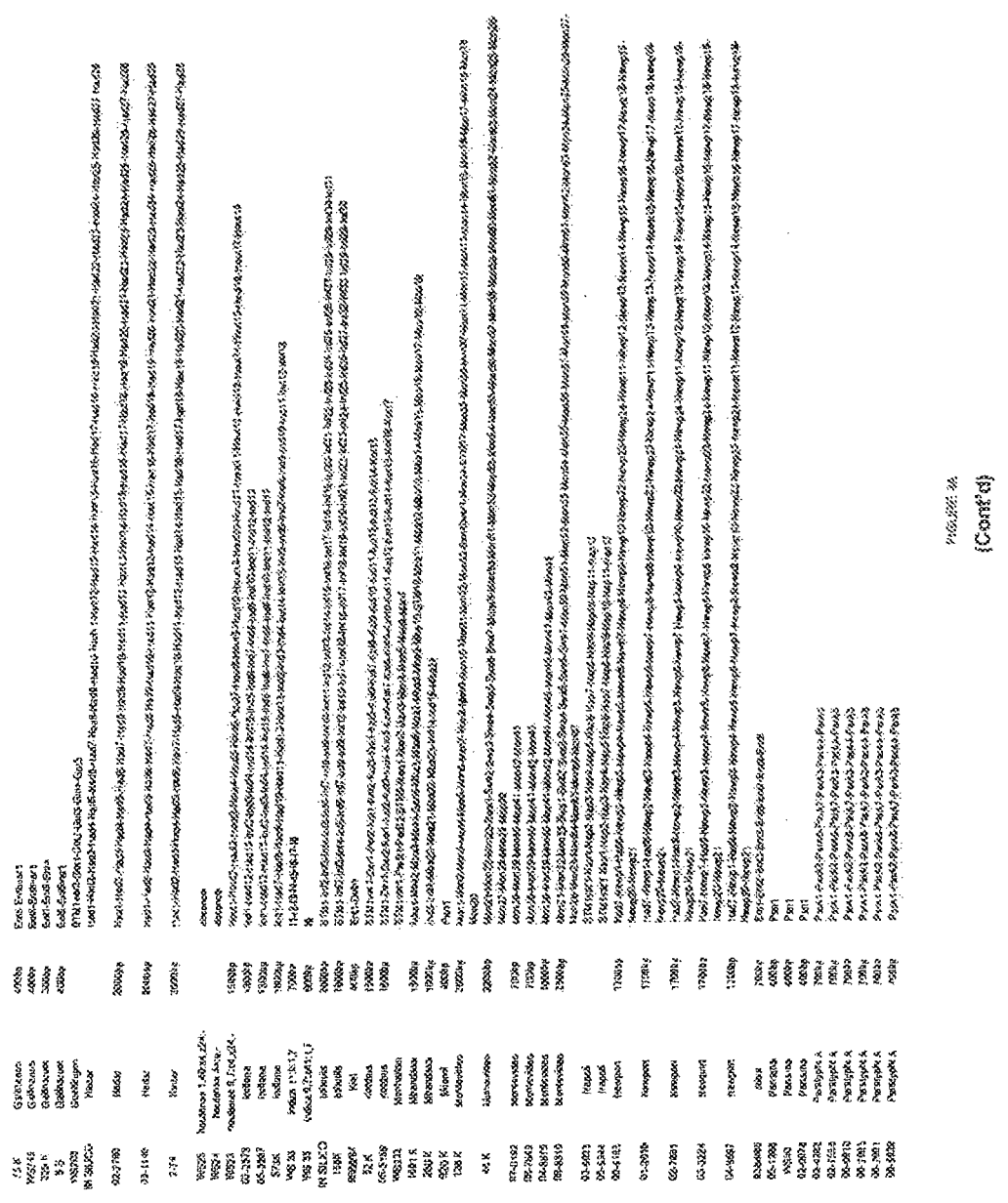
Figure 8A:
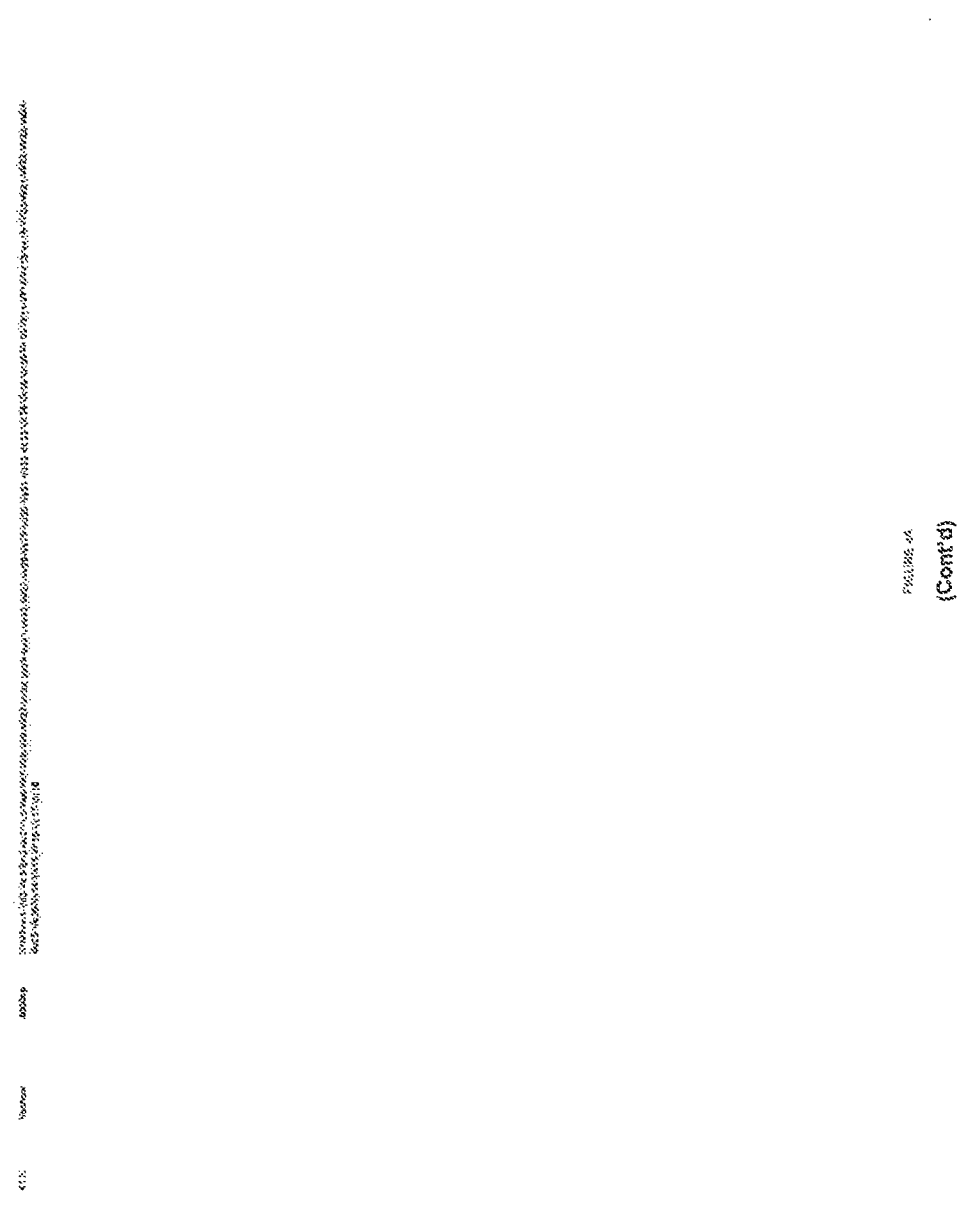

The sequence of the CRISPR1 locus (5' to 3') is represented in FIG. 8A.

The variable-sequence (spacer) composition of this sequence was determined as being the following: STM1-STM2-STM3-STM25-STM26-STM27-STM4-STM5-STM6-STM24,
in which:

```
STM1 (SEQ ID No.: 1106):
ATTTTTCAGCCCTTGTCGACTGCGGAACGCCCCT

STM2 (SEQ ID No.: 1123):
ACGCGAAATAGTGGGGAAAAACCCCTGGTTAACC
```

```
STM3 (SEQ ID No.: 1133):
ACTAGGCCTTGATACCATCGCTCGCACCTCGTCA

STM25 (SEQ ID No.: 1128):
ACGTTTATTACTGCTTAGTTAATTAATGGGTTGC

STM26 (SEQ ID No.: 1129):
ACAGGCGAATAATCTCTAATAGTCTCAATTCGTT

STM27 (SEQ ID No.: 1130):
ACTAAATCTGGCGTCGAGACATTCGAAATAGTGC

STM4 (SEQ ID No.: 1137):
ACTCTTTTGATTTTGCTGCGATGTTATAACCAGA

STM5 (SEQ ID No.: 1138):
ACTATCCACATATACCCGCAATCATATTCAAGAA

STM6 (SEQ ID No.: 1139):
ACAATCACTGCGGGGGTATTTAGCGGAAACGGCT

STM24 (SEQ ID No.: 1127):
ACCAGCACGAAAAATTATTTACTGTCGTTGCTCA.
```

After comparison, with the reference base (FIGS. 2 and 9), of the composition of the CRISPR1 locus of the isolated bacterium, it was determined that the strain 02-1941 had the same spacer composition as the strains of *Salmonella enterica* serotype Typhimurium. This result was confirmed by serotyping. In addition, its spacer composition was found in the database virtually exclusively in the strains of *S. enterica*, serotype Typhimurium.

The analysis of a single CRISPR locus (in this case, the CRISPR1 locus) made it possible to identify the bacterial strain isolated.

SEQUENCE LISTING (2157 sequences)

SEQ ID NO: 1 - DNA, 34 bp, Artificial Sequence
  Description of Artificial Sequence: Synthetic spacer oligonucleotide
accgattttgggggcaaatttgggggcaaaaatg

SEQ ID NO: 2 - DNA, 34 bp, Artificial Sequence
  Description of Artificial Sequence: Synthetic spacer oligonucleotide
actagaccgtaatcgaggatgcaactctgtgagc

SEQ ID NO: 3 - DNA, 34 bp, Artificial Sequence
  Description of Artificial Sequence: Synthetic spacer oligonucleotide
acaatctggtacgcggcaagcgccgtttcgatac

SEQ ID NO: 4 - DNA, 34 bp, Artificial Sequence
  Description of Artificial Sequence: Synthetic spacer oligonucleotide
actctatcctataatcaacaatattaaatgttcg

SEQ ID NO: 5 - DNA, 34 bp, Artificial Sequence
  Description of Artificial Sequence: Synthetic spacer oligonucleotide
actataattatgtcggattccgctcttccggagg

SEQ ID NO: 6 - DNA, 34 bp, Artificial Sequence
  Description of Artificial Sequence: Synthetic spacer oligonucleotide
actgaatgattttatcgatcgtccaatagacctg

SEQ ID NO: 7 - DNA, 34 bp, Artificial Sequence
  Description of Artificial Sequence: Synthetic spacer oligonucleotide
acataactcattacatccgcatcagaacccgtga

SEQ ID NO: 8 - DNA, 34 bp, Artificial Sequence
  Description of Artificial Sequence: Synthetic spacer oligonucleotide
actgtgcggattgacttttaatattttctacatt

SEQ ID NO: 9 - DNA, 34 bp, Artificial Sequence
  Description of Artificial Sequence: Synthetic spacer oligonucleotide
acagataaacccaaatctggccggtggaattttc

SEQ ID NO: 10 - DNA, 34 bp, Artificial Sequence
  Description of Artificial Sequence: Synthetic spacer oligonucleotide
actccaccaatgaacaaaacttgtggcatttcat

SEQ ID NO: 11 - DNA, 34 bp, Artificial Sequence
  Description of Artificial Sequence: Synthetic spacer oligonucleotide
acatggatggctcatatccggtttctgtttctgc

SEQ ID NO: 12 - DNA, 34 bp, Artificial Sequence
  Description of Artificial Sequence: Synthetic spacer oligonucleotide
acagctccggcagggtcatgtcccggcaggtgcg

SEQ ID NO: 13 - DNA, 34 bp, Artificial Sequence
  Description of Artificial Sequence: Synthetic spacer oligonucleotide
acgttgtgacgagttcgtcgtcttttttttcgct

SEQ ID NO: 14 - DNA, 34 bp, Artificial Sequence
  Description of Artificial Sequence: Synthetic spacer oligonucleotide
actagggaacctggctaaagtgtctgaaggctac

SEQ ID NO: 15 - DNA, 34 bp, Artificial Sequence
  Description of Artificial Sequence: Synthetic spacer oligonucleotide
acaatttttctgcggccagcgcggccagcgcctc

SEQ ID NO: 16 - DNA, 34 bp, Artificial Sequence
  Description of Artificial Sequence: Synthetic spacer oligonucleotide
actggcgccagaaatattcatgatcatcgggatt

SEQ ID NO: 17 - DNA, 34 bp, Artificial Sequence
  Description of Artificial Sequence: Synthetic spacer oligonucleotide
acttcatattccagaaaatgcctgggtgatgatc

SEQ ID NO: 18 - DNA, 34 bp, Artificial Sequence
  Description of Artificial Sequence: Synthetic spacer oligonucleotide
acgtggtatctcctgtcgaccttgccgttaaaat

SEQ ID NO: 19 - DNA, 34 bp, Artificial Sequence
  Description of Artificial Sequence: Synthetic spacer oligonucleotide
actataactggcgggttttagtgtcgttataaaa

SEQ ID NO: 20 - DNA, 34 bp, Artificial Sequence
  Description of Artificial Sequence: Synthetic spacer oligonucleotide
actcaggcttgacgacagtctccagccactcctg

SEQ ID NO: 21 - DNA, 34 bp, Artificial Sequence
  Description of Artificial Sequence: Synthetic spacer oligonucleotide
acgaccgcgcgggctatcgttcaggactattttt

SEQ ID NO: 22 - DNA, 34 bp, Artificial Sequence
  Description of Artificial Sequence: Synthetic spacer oligonucleotide
acctctgttacaccgttatgcacagaccacacag

SEQ ID NO: 23 - DNA, 34 bp, Artificial Sequence
  Description of Artificial Sequence: Synthetic spacer oligonucleotide
acgttaatgcaagcgccattaacaagaaaatgac

SEQ ID NO: 24 - DNA, 34 bp, Artificial Sequence
  Description of Artificial Sequence: Synthetic spacer oligonucleotide
acctgctcagcgataaccggcaggtttagccgct

SEQ ID NO: 25 - DNA, 34 bp, Artificial Sequence
  Description of Artificial Sequence: Synthetic spacer oligonucleotide
acttgccgaccagatcaatgacaacgctaacctt

SEQ ID NO: 26 - DNA, 34 bp, Artificial Sequence
  Description of Artificial Sequence: Synthetic spacer oligonucleotide
accagatcacaacgggtgacgtgatttttggaaa

SEQ ID NO: 27 - DNA, 34 bp, Artificial Sequence
  Description of Artificial Sequence: Synthetic spacer oligonucleotide
actcgtttttatctgcatctcactcccccttaac

SEQ ID NO: 28 - DNA, 34 bp, Artificial Sequence
  Description of Artificial Sequence: Synthetic spacer oligonucleotide
acgcctaagccgggatttgctttaggccagttgg

SEQ ID NO: 29 - DNA, 34 bp, Artificial Sequence
  Description of Artificial Sequence: Synthetic spacer oligonucleotide
acaataaatgggatgatcctgttgtccgggatgc

SEQ ID NO: 30 - DNA, 34 bp, Artificial Sequence
  Description of Artificial Sequence: Synthetic spacer oligonucleotide
actccatcgcttttgccaatctatcagacaattt

SEQ ID NO: 31 - DNA, 34 bp, Artificial Sequence
  Description of Artificial Sequence: Synthetic spacer oligonucleotide
acggcgactaacggcgtgctgaccagccagtcgc

SEQ ID NO: 32 - DNA, 34 bp, Artificial Sequence
  Description of Artificial Sequence: Synthetic spacer oligonucleotide
acaaaaactaaatcgcaaataaccaaaaatatca

SEQ ID NO: 33 - DNA, 34 bp, Artificial Sequence
  Description of Artificial Sequence: Synthetic spacer oligonucleotide
acacggtttaattcctatagccagtgccaggcgg

SEQ ID NO: 34 - DNA, 34 bp, Artificial Sequence
  Description of Artificial Sequence: Synthetic spacer oligonucleotide
actccagttgccgcgcatcccagcgggcaatgtc

SEQ ID NO: 35 - DNA, 34 bp, Artificial Sequence
  Description of Artificial Sequence: Synthetic spacer oligonucleotide
acggctgtttgcgttgagcgcaactttagcgagt

SEQ ID NO: 36 - DNA, 29 bp, Artificial Sequence
  Description of Artificial Sequence: Synthetic spacer oligonucleotide
acgcaggtggggcatttgggtaaatcgtt

SEQ ID NO: 37 - DNA, 34 bp, Artificial Sequence
  Description of Artificial Sequence: Synthetic spacer oligonucleotide
accgtgcgacgaaatcgaccagtgatttgtgggg

SEQ ID NO: 38 - DNA, 34 bp, Artificial Sequence
  Description of Artificial Sequence: Synthetic spacer oligonucleotide
acggtgatattagcttttttagctatcaacgtgc

SEQ ID NO: 39 - DNA, 34 bp, Artificial Sequence
  Description of Artificial Sequence: Synthetic spacer oligonucleotide
acgaaattgctgtttgccaggccgtctttaaacg

SEQ ID NO: 40 - DNA, 34 bp, Artificial Sequence
  Description of Artificial Sequence: Synthetic spacer oligonucleotide
actcgtaaaccagcacacccggtgtgctgaccgg

SEQ ID NO: 41 - DNA, 34 bp, Artificial Sequence
  Description of Artificial Sequence: Synthetic spacer oligonucleotide
accaatagcgtcacgatcggatatgtaagcgccg

SEQ ID NO: 42 - DNA, 34 bp, Artificial Sequence
  Description of Artificial Sequence: Synthetic spacer oligonucleotide
actcaaaagcgtataggaatagcctacgcgcaat

SEQ ID NO: 43 - DNA, 34 bp, Artificial Sequence
  Description of Artificial Sequence: Synthetic spacer oligonucleotide
acctgatagaaacaagaaagcgggcatttgcccg

SEQ ID NO: 44 - DNA, 34 bp, Artificial Sequence
  Description of Artificial Sequence: Synthetic spacer oligonucleotide
actggacgttcagattccgaatcctgagcatcgc

SEQ ID NO: 45 - DNA, 34 bp, Artificial Sequence
  Description of Artificial Sequence: Synthetic spacer oligonucleotide
actagcagataatcagtattaccgattaatcccg

SEQ ID NO: 46 - DNA, 34 bp, Artificial Sequence
  Description of Artificial Sequence: Synthetic spacer oligonucleotide
actgtggcattctgaaaataaattttacctgttt

SEQ ID NO: 47 - DNA, 34 bp, Artificial Sequence
  Description of Artificial Sequence: Synthetic spacer oligonucleotide
acgccatcagaaatggtacaacctcggcacggtt

SEQ ID NO: 48 - DNA, 34 bp, Artificial Sequence
  Description of Artificial Sequence: Synthetic spacer oligonucleotide
acgcaaaaagagcgcgctggcggcaattcttgag

SEQ ID NO: 49 - DNA, 32 bp, Artificial Sequence
  Description of Artificial Sequence: Synthetic spacer oligonucleotide
aaagatggccgggactattcacaccacgaagc

SEQ ID NO: 50 - DNA, 34 bp, Artificial Sequence
  Description of Artificial Sequence: Synthetic spacer oligonucleotide
acactatttttagcctatagctcaagatgtatct

SEQ ID NO: 51 - DNA, 34 bp, Artificial Sequence
  Description of Artificial Sequence: Synthetic spacer oligonucleotide
acggttgctccggactatttgagccgggcgtttt

SEQ ID NO: 52 - DNA, 34 bp, Artificial Sequence
  Description of Artificial Sequence: Synthetic spacer oligonucleotide
acggtgtgggtaaagttaacactgattatatatg

SEQ ID NO: 53 - DNA, 35 bp, Artificial Sequence
  Description of Artificial Sequence: Synthetic spacer oligonucleotide
acgcagcaacgaggtttccagcgagctaaacccgg

SEQ ID NO: 54 - DNA, 34 bp, Artificial Sequence
  Description of Artificial Sequence: Synthetic spacer oligonucleotide
accgcgtgccactgtatgtggaataggccagtac

SEQ ID NO: 55 - DNA, 34 bp, Artificial Sequence
  Description of Artificial Sequence: Synthetic spacer oligonucleotide
actgtatatccggcccctgattgctggtggataa

SEQ ID NO: 56 - DNA, 34 bp, Artificial Sequence
  Description of Artificial Sequence: Synthetic spacer oligonucleotide
acccgtcttcgtcgtgcgtatccggtatatagac

SEQ ID NO: 57 - DNA, 34 bp, Artificial Sequence
  Description of Artificial Sequence: Synthetic spacer oligonucleotide
acgttcgtcgccagcgccgcaccgctgcgggcgt

SEQ ID NO: 58 - DNA, 34 bp, Artificial Sequence
  Description of Artificial Sequence: Synthetic spacer oligonucleotide
acacccagcacgcgcccgtccagcattcgtagcc

SEQ ID NO: 59 - DNA, 34 bp, Artificial Sequence
  Description of Artificial Sequence: Synthetic spacer oligonucleotide
acacgccctctgtgttgacaccctctgccgcaat

SEQ ID NO: 60 - DNA, 34 bp, Artificial Sequence
  Description of Artificial Sequence: Synthetic spacer oligonucleotide
actccacggtggccccctgtacaccgtgttaaca

SEQ ID NO: 61 - DNA, 34 bp, Artificial Sequence
  Description of Artificial Sequence: Synthetic spacer oligonucleotide
actggatcgccggttgaggtgattgcagcaatgc

SEQ ID NO: 62 - DNA, 34 bp, Artificial Sequence
  Description of Artificial Sequence: Synthetic spacer oligonucleotide
acctgctatgagaatacggcgtgtaaagggatgc

SEQ ID NO: 63 - DNA, 34 bp, Artificial Sequence
  Description of Artificial Sequence: Synthetic spacer oligonucleotide
acgggcgctgcgggttattttcgaaagcgttacg

SEQ ID NO: 64 - DNA, 34 bp, Artificial Sequence
  Description of Artificial Sequence: Synthetic spacer oligonucleotide
acgcgtgctgagggcgacgctggaaagattcacc

SEQ ID NO: 65 - DNA, 34 bp, Artificial Sequence
  Description of Artificial Sequence: Synthetic spacer oligonucleotide
acgagcaaataacgctggaatcaattacagaggc

SEQ ID NO: 66 - DNA, 34 bp, Artificial Sequence
  Description of Artificial Sequence: Synthetic spacer oligonucleotide
acggattagcgttctatgatgggggatagctgcg

SEQ ID NO: 67 - DNA, 34 bp, Artificial Sequence
  Description of Artificial Sequence: Synthetic spacer oligonucleotide
acggccgatgggcggatatccaggcgttgtgcga

SEQ ID NO: 68 - DNA, 35 bp, Artificial Sequence
  Description of Artificial Sequence: Synthetic spacer oligonucleotide
acgtaagtgaacattttggcaaaatattttttccc

SEQ ID NO: 69 - DNA, 34 bp, Artificial Sequence
  Description of Artificial Sequence: Synthetic spacer oligonucleotide
actcttttgcaatttacttcagcaattctggttt

SEQ ID NO: 70 - DNA, 34 bp, Artificial Sequence
  Description of Artificial Sequence: Synthetic spacer oligonucleotide
accgacgccactatcccgaaaatggttcggttca

SEQ ID NO: 71 - DNA, 34 bp, Artificial Sequence
  Description of Artificial Sequence: Synthetic spacer oligonucleotide
acctattgtttagattattaatgggtgaatatcc

SEQ ID NO: 72 - DNA, 34 bp, Artificial Sequence
  Description of Artificial Sequence: Synthetic spacer oligonucleotide
acgtatctattcccgccgttggcaggatttcctc

SEQ ID NO: 73 - DNA, 34 bp, Artificial Sequence
  Description of Artificial Sequence: Synthetic spacer oligonucleotide
acttttgccttgctgatgttctggcggaagatcg

SEQ ID NO: 74 - DNA, 34 bp, Artificial Sequence
  Description of Artificial Sequence: Synthetic spacer oligonucleotide
accgctccctggttaattcatcgtttagccgctc

SEQ ID NO: 75 - DNA, 34 bp, Artificial Sequence
  Description of Artificial Sequence: Synthetic spacer oligonucleotide
acaccaaaacactgaaagccattcctctggcgta

SEQ ID NO: 76 - DNA, 34 bp, Artificial Sequence
  Description of Artificial Sequence: Synthetic spacer oligonucleotide
acgatttagagtcctgctgtggaaaagacgcgtc

SEQ ID NO: 77 - DNA, 32 bp, Artificial Sequence
  Description of Artificial Sequence: Synthetic spacer oligonucleotide
gatgaagtgggggatctgcaatgacggaaccg

SEQ ID NO: 78 - DNA, 34 bp, Artificial Sequence
  Description of Artificial Sequence: Synthetic spacer oligonucleotide
accagcgccagccgtccctcgtactgattcgccg

SEQ ID NO: 79 - DNA, 34 bp, Artificial Sequence
  Description of Artificial Sequence: Synthetic spacer oligonucleotide
acggtggggattaatgctggagttgtaccgctcg

SEQ ID NO: 80 - DNA, 32 bp, Artificial Sequence
  Description of Artificial Sequence: Synthetic spacer oligonucleotide
accacaccgatctgatcactccagtcgtggtc

SEQ ID NO: 81 - DNA, 34 bp, Artificial Sequence
  Description of Artificial Sequence: Synthetic spacer oligonucleotide
acaaaatgatgcgccgcattcgtgcgctaatgag

SEQ ID NO: 82 - DNA, 34 bp, Artificial Sequence
  Description of Artificial Sequence: Synthetic spacer oligonucleotide
actgtggcaattcgcaatcaataccggcctgcgc

SEQ ID NO: 83 - DNA, 34 bp, Artificial Sequence
  Description of Artificial Sequence: Synthetic spacer oligonucleotide
acatcccccccccgctctatatgagattgattac

SEQ ID NO: 84 - DNA, 34 bp, Artificial Sequence
  Description of Artificial Sequence: Synthetic spacer oligonucleotide
acattgctgccggtgctgccgcaggcgcgctggc

SEQ ID NO: 85 - DNA, 34 bp, Artificial Sequence
  Description of Artificial Sequence: Synthetic spacer oligonucleotide
actcaatagcgtcggattcttcacattcggagcc

SEQ ID NO: 86 - DNA, 34 bp, Artificial Sequence
  Description of Artificial Sequence: Synthetic spacer oligonucleotide
acgcgctcatcataaatagcctgctcacactcgg

SEQ ID NO: 87 - DNA, 32 bp, Artificial Sequence
  Description of Artificial Sequence: Synthetic spacer oligonucleotide
cgtgtattgtttgcgcccgccgtagtcgattt

SEQ ID NO: 88 - DNA, 34 bp, Artificial Sequence
  Description of Artificial Sequence: Synthetic spacer oligonucleotide
accctggtgtttcgtgcaaagtcagggtttacct

SEQ ID NO: 89 - DNA, 34 bp, Artificial Sequence
  Description of Artificial Sequence: Synthetic spacer oligonucleotide
acagcaccgatgattataactggcgttctgtgtg

SEQ ID NO: 90 - DNA, 34 bp, Artificial Sequence
  Description of Artificial Sequence: Synthetic spacer oligonucleotide
accaccatctcagcgttaaaaatcattccgcgct

SEQ ID NO: 91 - DNA, 34 bp, Artificial Sequence
  Description of Artificial Sequence: Synthetic spacer oligonucleotide
acactattaaaaccgtcacgtgtataacgatgac

SEQ ID NO: 92 - DNA, 34 bp, Artificial Sequence
  Description of Artificial Sequence: Synthetic spacer oligonucleotide
actgtctccggaacgtcagatggaattgctcgcg

SEQ ID NO: 93 - DNA, 34 bp, Artificial Sequence
  Description of Artificial Sequence: Synthetic spacer oligonucleotide
actccggcgacacagtgcgctcgatcgggtatta

SEQ ID NO: 94 - DNA, 34 bp, Artificial Sequence
  Description of Artificial Sequence: Synthetic spacer oligonucleotide
accatctctttccccattgataacgatcaatcaa

SEQ ID NO: 95 - DNA, 34 bp, Artificial Sequence
  Description of Artificial Sequence: Synthetic spacer oligonucleotide
atcgggaacggagcacgagtcgggcaaactgcaa

SEQ ID NO: 96 - DNA, 34 bp, Artificial Sequence
  Description of Artificial Sequence: Synthetic spacer oligonucleotide
actctgataattcagggaaattcgtcattctgac

SEQ ID NO: 97 - DNA, 34 bp, Artificial Sequence
  Description of Artificial Sequence: Synthetic spacer oligonucleotide
accgtattaccgtgaatcgctattttgtttgccg

SEQ ID NO: 98 - DNA, 34 bp, Artificial Sequence
  Description of Artificial Sequence: Synthetic spacer oligonucleotide
acgttcatttgcgccatcccaccattgagaaacg

SEQ ID NO: 99 - DNA, 34 bp, Artificial Sequence
  Description of Artificial Sequence: Synthetic spacer oligonucleotide
acattaattccgttagtatatcgctgaatatatc

SEQ ID NO: 100 - DNA, 34 bp, Artificial Sequence
  Description of Artificial Sequence: Synthetic spacer oligonucleotide
acttaacaagttgttagcgtaagatgactatatg

SEQ ID NO: 101 - DNA, 34 bp, Artificial Sequence
  Description of Artificial Sequence: Synthetic spacer oligonucleotide
actctatgccagctaatgacggaaacaggaatta

SEQ ID NO: 102 - DNA, 34 bp, Artificial Sequence
  Description of Artificial Sequence: Synthetic spacer oligonucleotide
actaatttctcccgcacttaataaatctattatt

SEQ ID NO: 103 - DNA, 34 bp, Artificial Sequence
  Description of Artificial Sequence: Synthetic spacer oligonucleotide
actttttgatttttataacgttggagtcgcccaa

SEQ ID NO: 104 - DNA, 34 bp, Artificial Sequence
  Description of Artificial Sequence: Synthetic spacer oligonucleotide
acctaaaactgtgggtctagcacctccatccccc

SEQ ID NO: 105 - DNA, 34 bp, Artificial Sequence
  Description of Artificial Sequence: Synthetic spacer oligonucleotide
actgtaccacatttgcccggtgtaacgtataccc

SEQ ID NO: 106 - DNA, 34 bp, Artificial Sequence
  Description of Artificial Sequence: Synthetic spacer oligonucleotide
acccgtgttcctggctcgcggtggtctgatgtct

SEQ ID NO: 107 - DNA, 34 bp, Artificial Sequence
  Description of Artificial Sequence: Synthetic spacer oligonucleotide
acctaccctaaatctttgccaatctctccatacg

SEQ ID NO: 108 - DNA, 34 bp, Artificial Sequence
  Description of Artificial Sequence: Synthetic spacer oligonucleotide
acaacacattgcgtttagaaaataacactattta

SEQ ID NO: 109 - DNA, 34 bp, Artificial Sequence
  Description of Artificial Sequence: Synthetic spacer oligonucleotide
acactacgtaaattggcgtggatcgcgtcggcac

SEQ ID NO: 110 - DNA, 34 bp, Artificial Sequence
  Description of Artificial Sequence: Synthetic spacer oligonucleotide
acaaagctaattcccaatttttataccgttttcc

SEQ ID NO: 111 - DNA, 34 bp, Artificial Sequence
  Description of Artificial Sequence: Synthetic spacer oligonucleotide
acattaataaattgctgcatttgccattcgctgg

SEQ ID NO: 112 - DNA, 34 bp, Artificial Sequence
  Description of Artificial Sequence: Synthetic spacer oligonucleotide
acaatcaatatgcagtgatgcgggattatctaga

SEQ ID NO: 113 - DNA, 34 bp, Artificial Sequence
  Description of Artificial Sequence: Synthetic spacer oligonucleotide
acattcagggtaaacgaacgattaaatacccggt

SEQ ID NO: 114 - DNA, 34 bp, Artificial Sequence
  Description of Artificial Sequence: Synthetic spacer oligonucleotide
acattttcattattcatcctgtgacggttttttg

SEQ ID NO: 115 - DNA, 33 bp, Artificial Sequence
  Description of Artificial Sequence: Synthetic spacer oligonucleotide
acattgggttatttgtaattcctgtgccagatg

SEQ ID NO: 116 - DNA, 34 bp, Artificial Sequence
  Description of Artificial Sequence: Synthetic spacer oligonucleotide
acagattatttaggggagtcaagtaacgtagaag

SEQ ID NO: 117 - DNA, 34 bp, Artificial Sequence
  Description of Artificial Sequence: Synthetic spacer oligonucleotide
actagtaactggcggaaataaggcaatcaatcag

SEQ ID NO: 118 - DNA, 34 bp, Artificial Sequence
  Description of Artificial Sequence: Synthetic spacer oligonucleotide
actgatatccattgacacccctccgtattgaatt

SEQ ID NO: 119 - DNA, 34 bp, Artificial Sequence
  Description of Artificial Sequence: Synthetic spacer oligonucleotide
acttaatccagcatatcctcctgatggaatatca

SEQ ID NO: 120 - DNA, 35 bp, Artificial Sequence
  Description of Artificial Sequence: Synthetic spacer oligonucleotide
acatctcaaacaagttctttatatttatccatttt

SEQ ID NO: 121 - DNA, 34 bp, Artificial Sequence
  Description of Artificial Sequence: Synthetic spacer oligonucleotide
acacaggttcaacaggcaatttaaatgaagccat

SEQ ID NO: 122 - DNA, 34 bp, Artificial Sequence
  Description of Artificial Sequence: Synthetic spacer oligonucleotide
acaggagcgcaaggaacggcgcgacaaagcggcg

SEQ ID NO: 123 - DNA, 34 bp, Artificial Sequence
  Description of Artificial Sequence: Synthetic spacer oligonucleotide
acgtgatatttatttgtttatttaattaaaaaca

SEQ ID NO: 124 - DNA, 35 bp, Artificial Sequence
  Description of Artificial Sequence: Synthetic spacer oligonucleotide
acgcctttttccatgtggacaccaaatccgcagaa

SEQ ID NO: 125 - DNA, 34 bp, Artificial Sequence
  Description of Artificial Sequence: Synthetic spacer oligonucleotide
acgtgctcagttcctgcaactcaacgtcaacctg

SEQ ID NO: 126 - DNA, 34 bp, Artificial Sequence
  Description of Artificial Sequence: Synthetic spacer oligonucleotide
acccatgattaagtgctcctgttaactgttattt

SEQ ID NO: 127 - DNA, 34 bp, Artificial Sequence
  Description of Artificial Sequence: Synthetic spacer oligonucleotide
acttcccagatgattttgaatgcagcgccaacgc

SEQ ID NO: 128 - DNA, 34 bp, Artificial Sequence
  Description of Artificial Sequence: Synthetic spacer oligonucleotide
acgtgctcattgcgcgcgaagacacgtaaacacg

SEQ ID NO: 129 - DNA, 34 bp, Artificial Sequence
  Description of Artificial Sequence: Synthetic spacer oligonucleotide
actggataatcgtccaggcctcagacgggtagtg

SEQ ID NO: 130 - DNA, 34 bp, Artificial Sequence
  Description of Artificial Sequence: Synthetic spacer oligonucleotide
actttcgcctggttatgcccggcgtttttgttgc

SEQ ID NO: 131 - DNA, 34 bp, Artificial Sequence
  Description of Artificial Sequence: Synthetic spacer oligonucleotide
actttcgcctggttatgcccggcgtttttgttgt

SEQ ID NO: 132 - DNA, 34 bp, Artificial Sequence
  Description of Artificial Sequence: Synthetic spacer oligonucleotide
actgagtggtggaagaaaatgatgtgacaatagc

SEQ ID NO: 133 - DNA, 35 bp, Artificial Sequence
  Description of Artificial Sequence: Synthetic spacer oligonucleotide
acgccttgccaatcagattaatggtttggctactg

SEQ ID NO: 134 - DNA, 34 bp, Artificial Sequence
  Description of Artificial Sequence: Synthetic spacer oligonucleotide
acaaggcgttaaggatgattatacaaataatatt

SEQ ID NO: 135 - DNA, 34 bp, Artificial Sequence
  Description of Artificial Sequence: Synthetic spacer oligonucleotide
acgctggtattggtactatggtgggaggtcattg

SEQ ID NO: 136 - DNA, 34 bp, Artificial Sequence
  Description of Artificial Sequence: Synthetic spacer oligonucleotide
acgtcggcctcatctctcagtgatttttcaactc

SEQ ID NO: 137 - DNA, 34 bp, Artificial Sequence
  Description of Artificial Sequence: Synthetic spacer oligonucleotide
acttttatcttgatggcatactgaaggccaacca

SEQ ID NO: 138 - DNA, 34 bp, Artificial Sequence
  Description of Artificial Sequence: Synthetic spacer oligonucleotide
accataatgtttccgccttacatgtaaatagtga

SEQ ID NO: 139 - DNA, 34 bp, Artificial Sequence
  Description of Artificial Sequence: Synthetic spacer oligonucleotide
actattttatcagggtcaaatccaagttttgagg

SEQ ID NO: 140 - DNA, 34 bp, Artificial Sequence
  Description of Artificial Sequence: Synthetic spacer oligonucleotide
actgtgaaatcggatcaaggcgaggaagcagagt

SEQ ID NO: 141 - DNA, 34 bp, Artificial Sequence
  Description of Artificial Sequence: Synthetic spacer oligonucleotide
acggcgcgaattgatttaaacggcaactggattc

SEQ ID NO: 142 - DNA, 34 bp, Artificial Sequence
  Description of Artificial Sequence: Synthetic spacer oligonucleotide
acggtggctcagttcctgttggtgtggtcgtcga

SEQ ID NO: 143 - DNA, 34 bp, Artificial Sequence
  Description of Artificial Sequence: Synthetic spacer oligonucleotide
acgggaactcactgatagacgtttgccgcgacga

SEQ ID NO: 144 - DNA, 34 bp, Artificial Sequence
  Description of Artificial Sequence: Synthetic spacer oligonucleotide
acacttaccgttacatcaaatgccgaaaaaattc

SEQ ID NO: 145 - DNA, 35 bp, Artificial Sequence
  Description of Artificial Sequence: Synthetic spacer oligonucleotide
acgaatacgcgcccgcccatcactctctaacactc

SEQ ID NO: 146 - DNA, 34 bp, Artificial Sequence
  Description of Artificial Sequence: Synthetic spacer oligonucleotide
acacagcccattacttcttctcgttctgcgcagc

SEQ ID NO: 147 - DNA, 34 bp, Artificial Sequence
  Description of Artificial Sequence: Synthetic spacer oligonucleotide
acaccatcaactggatggaatcctcgatggcgtc

SEQ ID NO: 148 - DNA, 34 bp, Artificial Sequence
  Description of Artificial Sequence: Synthetic spacer oligonucleotide
acgaacttgaataaacagtttgacgaactattcg

SEQ ID NO: 149 - DNA, 34 bp, Artificial Sequence
  Description of Artificial Sequence: Synthetic spacer oligonucleotide
acggcgtgtctgaataacggcggttacgtcgccc

SEQ ID NO: 150 - DNA, 34 bp, Artificial Sequence
  Description of Artificial Sequence: Synthetic spacer oligonucleotide
acgtgctggcgatctggttttcgttgagttcctg

SEQ ID NO: 151 - DNA, 34 bp, Artificial Sequence
  Description of Artificial Sequence: Synthetic spacer oligonucleotide
acttttccgtgcgaaggggtatgattttgtttgc

SEQ ID NO: 152 - DNA, 34 bp, Artificial Sequence
  Description of Artificial Sequence: Synthetic spacer oligonucleotide
acttggctggaatgggggccgatggcaacctgta

SEQ ID NO: 153 - DNA, 34 bp, Artificial Sequence
  Description of Artificial Sequence: Synthetic spacer oligonucleotide
acctagaatgcaccccgtattttacacagcgtaa

SEQ ID NO: 154 - DNA, 34 bp, Artificial Sequence
  Description of Artificial Sequence: Synthetic spacer oligonucleotide
acaaccccttgtgtcggcaaaacccggttatgtc

SEQ ID NO: 155 - DNA, 34 bp, Artificial Sequence
  Description of Artificial Sequence: Synthetic spacer oligonucleotide
actccttgctaccaacaattgtagctgcaactcc

SEQ ID NO: 156 - DNA, 34 bp, Artificial Sequence
  Description of Artificial Sequence: Synthetic spacer oligonucleotide
acgagggcacccaaccgcagtatttttcatctgc

SEQ ID NO: 157 - DNA, 34 bp, Artificial Sequence
  Description of Artificial Sequence: Synthetic spacer oligonucleotide
acgcggcaaccatgatatttataatgaactcgct

SEQ ID NO: 158 - DNA, 34 bp, Artificial Sequence
  Description of Artificial Sequence: Synthetic spacer oligonucleotide
acaaaagttatcgtatgcgccgaattttatgact

SEQ ID NO: 159 - DNA, 34 bp, Artificial Sequence
  Description of Artificial Sequence: Synthetic spacer oligonucleotide
actacaaatagaagattaggattttcaggaataa

SEQ ID NO: 160 - DNA, 34 bp, Artificial Sequence
  Description of Artificial Sequence: Synthetic spacer oligonucleotide
acaccagcccagaaatcagcacgtcctgaattgt

SEQ ID NO: 161 - DNA, 34 bp, Artificial Sequence
  Description of Artificial Sequence: Synthetic spacer oligonucleotide
acttaattaaagtctcttcattatactgattaga

SEQ ID NO: 162 - DNA, 34 bp, Artificial Sequence
  Description of Artificial Sequence: Synthetic spacer oligonucleotide
acggatcaacctgacgcaacgcacggttaatggc

SEQ ID NO: 163 - DNA, 34 bp, Artificial Sequence
  Description of Artificial Sequence: Synthetic spacer oligonucleotide
acgctgttttagcattttattagcggtatccgcc

SEQ ID NO: 164 - DNA, 34 bp, Artificial Sequence
  Description of Artificial Sequence: Synthetic spacer oligonucleotide
acattttcagtacctccagatgggtcggttgccg

SEQ ID NO: 165 - DNA, 34 bp, Artificial Sequence
  Description of Artificial Sequence: Synthetic spacer oligonucleotide
actattccctcaccctgactgataaaaaaaccgc

SEQ ID NO: 166 - DNA, 34 bp, Artificial Sequence
  Description of Artificial Sequence: Synthetic spacer oligonucleotide
acggtaatttcaacgattggaacgtttttatcct

SEQ ID NO: 167 - DNA, 34 bp, Artificial Sequence
  Description of Artificial Sequence: Synthetic spacer oligonucleotide
acgtcagagccgttaccaaaggatgatccggaag

SEQ ID NO: 168 - DNA, 34 bp, Artificial Sequence
  Description of Artificial Sequence: Synthetic spacer oligonucleotide
actgtgtcacctgcatgatgtgttcatgctcaag

SEQ ID NO: 169 - DNA, 34 bp, Artificial Sequence
  Description of Artificial Sequence: Synthetic spacer oligonucleotide
acaatttcacttcttagcagaatgtacaggcgga

SEQ ID NO: 170 - DNA, 34 bp, Artificial Sequence
  Description of Artificial Sequence: Synthetic spacer oligonucleotide
acggcggcgtacccggcgagcggggaaatcaaca

SEQ ID NO: 171 - DNA, 34 bp, Artificial Sequence
  Description of Artificial Sequence: Synthetic spacer oligonucleotide
acttctttcgctgtccccttccacctctttttct

SEQ ID NO: 172 - DNA, 34 bp, Artificial Sequence
  Description of Artificial Sequence: Synthetic spacer oligonucleotide
acgcccgcgcccctttaaactcaagatacagtaa

SEQ ID NO: 173 - DNA, 34 bp, Artificial Sequence
  Description of Artificial Sequence: Synthetic spacer oligonucleotide
actgcggttctgtgatatttactgttgcagacgg

SEQ ID NO: 174 - DNA, 34 bp, Artificial Sequence
  Description of Artificial Sequence: Synthetic spacer oligonucleotide
accggtggggtctcctcgcgaagatgaagttacg

SEQ ID NO: 175 - DNA, 32 bp, Artificial Sequence
  Description of Artificial Sequence: Synthetic spacer oligonucleotide
attgggttatttgtaattcctgtgccagattg

SEQ ID NO: 176 - DNA, 34 bp, Artificial Sequence
  Description of Artificial Sequence: Synthetic spacer oligonucleotide
actcaaagtatgggccaaaaccaagacgcgcacc

SEQ ID NO: 177 - DNA, 34 bp, Artificial Sequence
  Description of Artificial Sequence: Synthetic spacer oligonucleotide
acctgagccgccccaattccagcctgagatacag

SEQ ID NO: 178 - DNA, 34 bp, Artificial Sequence
  Description of Artificial Sequence: Synthetic spacer oligonucleotide
acccagcaggaaacagcggatgcgtaactgtttc

SEQ ID NO: 179 - DNA, 34 bp, Artificial Sequence
  Description of Artificial Sequence: Synthetic spacer oligonucleotide
acatctaaaatattaacgttgcaatttccattac

SEQ ID NO: 180 - DNA, 33 bp, Artificial Sequence
  Description of Artificial Sequence: Synthetic spacer oligonucleotide
acgtaattacctgaataattaatctacttcttt

SEQ ID NO: 181 - DNA, 34 bp, Artificial Sequence
  Description of Artificial Sequence: Synthetic spacer oligonucleotide
acttccgtcaggattgcgctgtatgtatgccagc

SEQ ID NO: 182 - DNA, 34 bp, Artificial Sequence
  Description of Artificial Sequence: Synthetic spacer oligonucleotide
acaaacacgcgcgtcttcagttgaatgctaagcg

SEQ ID NO: 183 - DNA, 34 bp, Artificial Sequence
  Description of Artificial Sequence: Synthetic spacer oligonucleotide
acggtccccttttccaccccgtattggatattgt

SEQ ID NO: 184 - DNA, 34 bp, Artificial Sequence
  Description of Artificial Sequence: Synthetic spacer oligonucleotide
acttccagcaaacctaaatcaggagattcggtgc

SEQ ID NO: 185 - DNA, 34 bp, Artificial Sequence
  Description of Artificial Sequence: Synthetic spacer oligonucleotide
acagctaaatataaagcggcgcggcgcaattgtg

SEQ ID NO: 186 - DNA, 34 bp, Artificial Sequence
  Description of Artificial Sequence: Synthetic spacer oligonucleotide
actcgctaatcatttttgctccgtggtagaggcc

SEQ ID NO: 187 - DNA, 34 bp, Artificial Sequence
  Description of Artificial Sequence: Synthetic spacer oligonucleotide
accaggccgaacaattacgcaactggagaacagg

SEQ ID NO: 188 - DNA, 34 bp, Artificial Sequence
  Description of Artificial Sequence: Synthetic spacer oligonucleotide
accaactgttcttcctgctcaggaggtaaggaac

SEQ ID NO: 189 - DNA, 34 bp, Artificial Sequence
  Description of Artificial Sequence: Synthetic spacer oligonucleotide
actgatcgatgacttgcgaaaatttggcgtacat

SEQ ID NO: 190 - DNA, 34 bp, Artificial Sequence
  Description of Artificial Sequence: Synthetic spacer oligonucleotide
acccagtagcgccaatcctgaactaaatcactcc

SEQ ID NO: 191 - DNA, 34 bp, Artificial Sequence
  Description of Artificial Sequence: Synthetic spacer oligonucleotide
acaaaaggcgttcctgacatttcatgtgatattc

SEQ ID NO: 192 - DNA, 34 bp, Artificial Sequence
  Description of Artificial Sequence: Synthetic spacer oligonucleotide
actttatagcgtagccctgataaaacaaaaaaaa

SEQ ID NO: 193 - DNA, 34 bp, Artificial Sequence
  Description of Artificial Sequence: Synthetic spacer oligonucleotide
acccgaagcaacaaatgcaacgtttaattattgg

SEQ ID NO: 194 - DNA, 34 bp, Artificial Sequence
  Description of Artificial Sequence: Synthetic spacer oligonucleotide
acaatcaagttttacacgctggccgagggcgaac

SEQ ID NO: 195 - DNA, 34 bp, Artificial Sequence
  Description of Artificial Sequence: Synthetic spacer oligonucleotide
acaactacgtaaattggcgtgctgcgcgtgggta

SEQ ID NO: 196 - DNA, 34 bp, Artificial Sequence
  Description of Artificial Sequence: Synthetic spacer oligonucleotide
acgcgagcgttttgggtggcacaaaatccccgag

SEQ ID NO: 197 - DNA, 34 bp, Artificial Sequence
  Description of Artificial Sequence: Synthetic spacer oligonucleotide
acgcgaaaccaaagacaacccattctgttccaat

SEQ ID NO: 198 - DNA, 34 bp, Artificial Sequence
  Description of Artificial Sequence: Synthetic spacer oligonucleotide
acgcgaaaccaaagacaacccatgctgttccaat

SEQ ID NO: 199 - DNA, 34 bp, Artificial Sequence
  Description of Artificial Sequence: Synthetic spacer oligonucleotide
acgaggttgttcacagccaattcgaggccgttat

SEQ ID NO: 200 - DNA, 34 bp, Artificial Sequence
  Description of Artificial Sequence: Synthetic spacer oligonucleotide
acttgcaaataccgggcaggaaatgaatgagacg

SEQ ID NO: 201 - DNA, 34 bp, Artificial Sequence
  Description of Artificial Sequence: Synthetic spacer oligonucleotide
actgtcatccctgatacgacaggattaccatcca

SEQ ID NO: 202 - DNA, 34 bp, Artificial Sequence
  Description of Artificial Sequence: Synthetic spacer oligonucleotide
acctaatcaaatctgtcggcttgtcgctgttcgc

SEQ ID NO: 203 - DNA, 34 bp, Artificial Sequence
  Description of Artificial Sequence: Synthetic spacer oligonucleotide
acgcagtgcatcattattccagtcgtccagggtg

SEQ ID NO: 204 - DNA, 34 bp, Artificial Sequence
  Description of Artificial Sequence: Synthetic spacer oligonucleotide
acctgaatattaatcagatcgccagcctgacaga

SEQ ID NO: 205 - DNA, 34 bp, Artificial Sequence
  Description of Artificial Sequence: Synthetic spacer oligonucleotide
acggtcgctgagaaaaacggggcgtacatggcat

SEQ ID NO: 206 - DNA, 35 bp, Artificial Sequence
  Description of Artificial Sequence: Synthetic spacer oligonucleotide
acgccatattgattaatataaatacctgtagtatt

SEQ ID NO: 207 - DNA, 34 bp, Artificial Sequence
  Description of Artificial Sequence: Synthetic spacer oligonucleotide
actttgacttcgtactcagttggtttgcgcacga

SEQ ID NO: 208 - DNA, 34 bp, Artificial Sequence
  Description of Artificial Sequence: Synthetic spacer oligonucleotide
acgcaatcatctcgtcaagccgcgcaattagacg

SEQ ID NO: 209 - DNA, 34 bp, Artificial Sequence
  Description of Artificial Sequence: Synthetic spacer oligonucleotide
accgtgcgagccgtatacggtaaaagacatcgat

SEQ ID NO: 210 - DNA, 34 bp, Artificial Sequence
  Description of Artificial Sequence: Synthetic spacer oligonucleotide
acccccctttaatctgttcattgctccagccacg

SEQ ID NO: 211 - DNA, 34 bp, Artificial Sequence
  Description of Artificial Sequence: Synthetic spacer oligonucleotide
acactacgcccattgtgataacgccatctccgcg

SEQ ID NO: 212 - DNA, 34 bp, Artificial Sequence
  Description of Artificial Sequence: Synthetic spacer oligonucleotide
actgagcaataaagatcaaaccgtctgttggatg

SEQ ID NO: 213 - DNA, 34 bp, Artificial Sequence
  Description of Artificial Sequence: Synthetic spacer oligonucleotide
acgttgtcggtgaatgaaaatttaaccctgttag

SEQ ID NO: 214 - DNA, 34 bp, Artificial Sequence
  Description of Artificial Sequence: Synthetic spacer oligonucleotide
acagcaaaataatcaacgggttgagctattccta

SEQ ID NO: 215 - DNA, 34 bp, Artificial Sequence
  Description of Artificial Sequence: Synthetic spacer oligonucleotide
acgctgcaggggacaaacgcggcgtcagggagcg

SEQ ID NO: 216 - DNA, 34 bp, Artificial Sequence
  Description of Artificial Sequence: Synthetic spacer oligonucleotide
actttaaattcagggtattcatactagtaaaccc

SEQ ID NO: 217 - DNA, 34 bp, Artificial Sequence
  Description of Artificial Sequence: Synthetic spacer oligonucleotide
acttcaggaagttcttcacgcaatgcctgaaaga

SEQ ID NO: 218 - DNA, 34 bp, Artificial Sequence
  Description of Artificial Sequence: Synthetic spacer oligonucleotide
acgttgatcaatacctcctggccgtggggattaa

SEQ ID NO: 219 - DNA, 34 bp, Artificial Sequence
  Description of Artificial Sequence: Synthetic spacer oligonucleotide
acatacgaagacatttaaaaatggattcgttggg

SEQ ID NO: 220 - DNA, 34 bp, Artificial Sequence
  Description of Artificial Sequence: Synthetic spacer oligonucleotide
acggtttaattaaatccgccattaaatttaccgg

SEQ ID NO: 221 - DNA, 34 bp, Artificial Sequence
  Description of Artificial Sequence: Synthetic spacer oligonucleotide
acgcagaagtctcaaataaatcaatatactcata

SEQ ID NO: 222 - DNA, 34 bp, Artificial Sequence
  Description of Artificial Sequence: Synthetic spacer oligonucleotide
acattgccgcctagcttcgtgataagctcggttg

SEQ ID NO: 223 - DNA, 34 bp, Artificial Sequence
  Description of Artificial Sequence: Synthetic spacer oligonucleotide
acgaagtgagataaaagaagaccaactatgtagc

SEQ ID NO: 224 - DNA, 34 bp, Artificial Sequence
  Description of Artificial Sequence: Synthetic spacer oligonucleotide
acgtgcatacgaaagaaggcatccggcctgatgg

SEQ ID NO: 225 - DNA, 34 bp, Artificial Sequence
  Description of Artificial Sequence: Synthetic spacer oligonucleotide
actactagcctttgcgcttacggaacgtttaacg

SEQ ID NO: 226 - DNA, 34 bp, Artificial Sequence
  Description of Artificial Sequence: Synthetic spacer oligonucleotide
actgctggataaaataactgacgacacccagcag

SEQ ID NO: 227 - DNA, 34 bp, Artificial Sequence
  Description of Artificial Sequence: Synthetic spacer oligonucleotide
acgttttatcccacggtatgatcccgcgccacgt

SEQ ID NO: 228 - DNA, 34 bp, Artificial Sequence
  Description of Artificial Sequence: Synthetic spacer oligonucleotide
actgcgccaagtacaggtaaagaacttcgtaagc

SEQ ID NO: 229 - DNA, 34 bp, Artificial Sequence
  Description of Artificial Sequence: Synthetic spacer oligonucleotide
acttaaccggctgttagggatgggaaataaactc

SEQ ID NO: 230 - DNA, 34 bp, Artificial Sequence
  Description of Artificial Sequence: Synthetic spacer oligonucleotide
acccgggcgcgtcggtgagtcggcggaaagggca

SEQ ID NO: 231 - DNA, 34 bp, Artificial Sequence
  Description of Artificial Sequence: Synthetic spacer oligonucleotide
acaaaacgtcgcagcgcctccgggcggacgtcgt

SEQ ID NO: 232 - DNA, 34 bp, Artificial Sequence
  Description of Artificial Sequence: Synthetic spacer oligonucleotide
actggccgcgcaaatcgtcatgatttaattgcgt

SEQ ID NO: 233 - DNA, 34 bp, Artificial Sequence
  Description of Artificial Sequence: Synthetic spacer oligonucleotide
accccgccttacgcagttctcgccctgatttccc

SEQ ID NO: 234 - DNA, 34 bp, Artificial Sequence
  Description of Artificial Sequence: Synthetic spacer oligonucleotide
acgcatcgcgaacgtgcacaatacgtccaccttt

SEQ ID NO: 235 - DNA, 34 bp, Artificial Sequence
  Description of Artificial Sequence: Synthetic spacer oligonucleotide
accctttcaaagggccagccgaggtcttcggaaa

SEQ ID NO: 236 - DNA, 34 bp, Artificial Sequence
  Description of Artificial Sequence: Synthetic spacer oligonucleotide
acatgtcccgactgctcggaatcaacgattcaac

SEQ ID NO: 237 - DNA, 34 bp, Artificial Sequence
  Description of Artificial Sequence: Synthetic spacer oligonucleotide
acatgccggttgtttgtgcgctcatgtgcgtttt

SEQ ID NO: 238 - DNA, 34 bp, Artificial Sequence
  Description of Artificial Sequence: Synthetic spacer oligonucleotide
actggaagatattgaaagcgcccaatcttcccag

SEQ ID NO: 239 - DNA, 34 bp, Artificial Sequence
  Description of Artificial Sequence: Synthetic spacer oligonucleotide
acccagtgtgctggagtgaggcgtgaatatgcag

SEQ ID NO: 240 - DNA, 34 bp, Artificial Sequence
  Description of Artificial Sequence: Synthetic spacer oligonucleotide
accggcgatgcgtcagtaccgacggtgaagccat

SEQ ID NO: 241 - DNA, 34 bp, Artificial Sequence
  Description of Artificial Sequence: Synthetic spacer oligonucleotide
acgaggcaatcagtgttgatgaggaaagcgaacg

SEQ ID NO: 242 - DNA, 34 bp, Artificial Sequence
  Description of Artificial Sequence: Synthetic spacer oligonucleotide
acccgtagtcagtcagtgaaatacttatgagccc

SEQ ID NO: 243 - DNA, 34 bp, Artificial Sequence
  Description of Artificial Sequence: Synthetic spacer oligonucleotide
actttttcttcaggttcgtagcggatggatttca

SEQ ID NO: 244 - DNA, 34 bp, Artificial Sequence
  Description of Artificial Sequence: Synthetic spacer oligonucleotide
actgcgtctttcccccgctggagttgaatattct

SEQ ID NO: 245 - DNA, 34 bp, Artificial Sequence
  Description of Artificial Sequence: Synthetic spacer oligonucleotide
acagcctctctgagatagtaagcgcggcctactg

SEQ ID NO: 246 - DNA, 34 bp, Artificial Sequence
  Description of Artificial Sequence: Synthetic spacer oligonucleotide
acggctttggcttcttcactcatatttatttgac

SEQ ID NO: 247 - DNA, 34 bp, Artificial Sequence
  Description of Artificial Sequence: Synthetic spacer oligonucleotide
accagttctgccggtaataacagggatttatttt

SEQ ID NO: 248 - DNA, 34 bp, Artificial Sequence
  Description of Artificial Sequence: Synthetic spacer oligonucleotide
acggccatgaccaggcagggattgcccgccaggg

SEQ ID NO: 249 - DNA, 34 bp, Artificial Sequence
  Description of Artificial Sequence: Synthetic spacer oligonucleotide
accgcatttcctgcataagtccctttttcatagg

SEQ ID NO: 250 - DNA, 35 bp, Artificial Sequence
  Description of Artificial Sequence: Synthetic spacer oligonucleotide
acatccgccaccagcgaaaccgacctccatcacca

SEQ ID NO: 251 - DNA, 34 bp, Artificial Sequence
  Description of Artificial Sequence: Synthetic spacer oligonucleotide
actactcggcgggttcacattcattcaaattacg

SEQ ID NO: 252 - DNA, 34 bp, Artificial Sequence
  Description of Artificial Sequence: Synthetic spacer oligonucleotide
acgtcctgagtgagctgaatagctgtaccgctgg

SEQ ID NO: 253 - DNA, 36 bp, Artificial Sequence
  Description of Artificial Sequence: Synthetic spacer oligonucleotide
actcgtgccagggggttatatcggtgagtctggaga

SEQ ID NO: 254 - DNA, 34 bp, Artificial Sequence
  Description of Artificial Sequence: Synthetic spacer oligonucleotide
acctcacccaggcggtaacgcaatttttcacgcg

SEQ ID NO: 255 - DNA, 34 bp, Artificial Sequence
  Description of Artificial Sequence: Synthetic spacer oligonucleotide
accaaaattttcggcagcgcatcacgccaagtag

SEQ ID NO: 256 - DNA, 34 bp, Artificial Sequence
  Description of Artificial Sequence: Synthetic spacer oligonucleotide
acatttcaacctcagcctcagcactcgcgatcac

SEQ ID NO: 257 - skipped

SEQ ID NO: 258 - DNA, 34 bp, Artificial Sequence
  Description of Artificial Sequence: Synthetic spacer oligonucleotide
acacccgatgacgacagcagctatatctccagtg

SEQ ID NO: 259 - DNA, 35 bp, Artificial Sequence
  Description of Artificial Sequence: Synthetic spacer oligonucleotide
actttcgcggaccggctttctttgaacttgttttc

SEQ ID NO: 260 - DNA, 34 bp, Artificial Sequence
  Description of Artificial Sequence: Synthetic spacer oligonucleotide
acgtctggtgaaggtgaaagggaggcgtattttt

SEQ ID NO: 261 - DNA, 34 bp, Artificial Sequence
  Description of Artificial Sequence: Synthetic spacer oligonucleotide
acgcggctgataaattcaaaaatggtgacgtccc

SEQ ID NO: 262 - DNA, 34 bp, Artificial Sequence
  Description of Artificial Sequence: Synthetic spacer oligonucleotide
acattaaattcaatgccctgccgaataaaaccgc

SEQ ID NO: 263 - DNA, 34 bp, Artificial Sequence
  Description of Artificial Sequence: Synthetic spacer oligonucleotide
acatccccgttaaggaagcagagctgctctgcga

SEQ ID NO: 264 - DNA, 34 bp, Artificial Sequence
  Description of Artificial Sequence: Synthetic spacer oligonucleotide
acttcaataaacactctcgttcaatggcttttaa

SEQ ID NO: 265 - DNA, 34 bp, Artificial Sequence
  Description of Artificial Sequence: Synthetic spacer oligonucleotide
actggtgaaatagttttagacaatccattgccag

SEQ ID NO: 266 - DNA, 34 bp, Artificial Sequence
  Description of Artificial Sequence: Synthetic spacer oligonucleotide
acggtaagtatatgatttcattacagttattata

SEQ ID NO: 267 - DNA, 34 bp, Artificial Sequence
  Description of Artificial Sequence: Synthetic spacer oligonucleotide
actaacgcatatataaccgttagcatgattgatg

SEQ ID NO: 268 - DNA, 34 bp, Artificial Sequence
  Description of Artificial Sequence: Synthetic spacer oligonucleotide
acttctgatatagattttacagtaattgaaatac

SEQ ID NO: 269 - DNA, 34 bp, Artificial Sequence
  Description of Artificial Sequence: Synthetic spacer oligonucleotide
acctcagcaggctggaggagatgatcaaaaatgg

SEQ ID NO: 270 - DNA, 34 bp, Artificial Sequence
  Description of Artificial Sequence: Synthetic spacer oligonucleotide
actttcatcataaatatattcaaccgttacggtg

SEQ ID NO: 271 - DNA, 36 bp, Artificial Sequence
  Description of Artificial Sequence: Synthetic spacer oligonucleotide
acacgttaccgttggcgtaacgctgaattgttggta

SEQ ID NO: 272 - DNA, 34 bp, Artificial Sequence
  Description of Artificial Sequence: Synthetic spacer oligonucleotide
acatctgcgagtgggcggctaagctgcggcccct

SEQ ID NO: 273 - DNA, 34 bp, Artificial Sequence
  Description of Artificial Sequence: Synthetic spacer oligonucleotide
acacagcgcatctggtgcaggattttaaaaatca

SEQ ID NO: 274 - DNA, 34 bp, Artificial Sequence
  Description of Artificial Sequence: Synthetic spacer oligonucleotide
acctttaatcagcagaacattttcagcgttgcga

SEQ ID NO: 275 - DNA, 34 bp, Artificial Sequence
  Description of Artificial Sequence: Synthetic spacer oligonucleotide
acgagccagattgccccggaccgctcgggaggct

SEQ ID NO: 276 - DNA, 34 bp, Artificial Sequence
  Description of Artificial Sequence: Synthetic spacer oligonucleotide
actcccgcatagtgcgtaatacgctgacgtcttc

SEQ ID NO: 277 - DNA, 34 bp, Artificial Sequence
  Description of Artificial Sequence: Synthetic spacer oligonucleotide
acggccgcatatgtccgcatatggctggtagcga

SEQ ID NO: 278 - DNA, 34 bp, Artificial Sequence
  Description of Artificial Sequence: Synthetic spacer oligonucleotide
acacgacgacgccgattttattgaatcctgcgtg

SEQ ID NO: 279 - DNA, 34 bp, Artificial Sequence
  Description of Artificial Sequence: Synthetic spacer oligonucleotide
actggtgcatgacgggtaaataaatcttcaaatg

SEQ ID NO: 280 - DNA, 34 bp, Artificial Sequence
  Description of Artificial Sequence: Synthetic spacer oligonucleotide
actgcgccacgcctataccatccgagttttgagc

SEQ ID NO: 281 - DNA, 34 bp, Artificial Sequence
  Description of Artificial Sequence: Synthetic spacer oligonucleotide
acggaataacgattgtatcagccatatattaatc

SEQ ID NO: 282 - DNA, 34 bp, Artificial Sequence
  Description of Artificial Sequence: Synthetic spacer oligonucleotide
acatgacgtcacaaataacgatgagactatattc

SEQ ID NO: 283 - DNA, 34 bp, Artificial Sequence
  Description of Artificial Sequence: Synthetic spacer oligonucleotide
acatgattaggaggtatcatgaaagttttattat

SEQ ID NO: 284 - DNA, 34 bp, Artificial Sequence
  Description of Artificial Sequence: Synthetic spacer oligonucleotide
acctataggttttaaagatgccatttgtgaaaat

SEQ ID NO: 285 - DNA, 34 bp, Artificial Sequence
  Description of Artificial Sequence: Synthetic spacer oligonucleotide
acagaaccatcatctgcaaatatgtcgcatttaa

SEQ ID NO: 286 - DNA, 34 bp, Artificial Sequence
  Description of Artificial Sequence: Synthetic spacer oligonucleotide
acgatttatcagaatccgaattatctgacggatt

SEQ ID NO: 287 - DNA, 35 bp, Artificial Sequence
  Description of Artificial Sequence: Synthetic spacer oligonucleotide
accacatattaataggaaatttcatataagccaca

SEQ ID NO: 288 - DNA, 34 bp, Artificial Sequence
  Description of Artificial Sequence: Synthetic spacer oligonucleotide
accatcatctgcggaacggtatagagcgcaatgt

SEQ ID NO: 289 - DNA, 34 bp, Artificial Sequence
  Description of Artificial Sequence: Synthetic spacer oligonucleotide
acttcaggaatagatttatatattggtgaatcat

SEQ ID NO: 290 - DNA, 34 bp, Artificial Sequence
  Description of Artificial Sequence: Synthetic spacer oligonucleotide
acaccactaagggtttcaaaatgactactaattt

SEQ ID NO: 291 - DNA, 34 bp, Artificial Sequence
  Description of Artificial Sequence: Synthetic spacer oligonucleotide
accgcgccagtgccaatgtgagctggcgttatta

SEQ ID NO: 292 - DNA, 34 bp, Artificial Sequence
  Description of Artificial Sequence: Synthetic spacer oligonucleotide
acttacgtaacaggccctgtgttttaccggagcc

SEQ ID NO: 293 - DNA, 34 bp, Artificial Sequence
  Description of Artificial Sequence: Synthetic spacer oligonucleotide
acaggcaaagaccagttacgatccggcctcaatc

SEQ ID NO: 294 - DNA, 34 bp, Artificial Sequence
  Description of Artificial Sequence: Synthetic spacer oligonucleotide
acgtaaacaccaatgcggcccactttttgcggcg

SEQ ID NO: 295 - DNA, 34 bp, Artificial Sequence
  Description of Artificial Sequence: Synthetic spacer oligonucleotide
acgagctggcgaacctgatggcgggcgacgtgga

SEQ ID NO: 296 - DNA, 34 bp, Artificial Sequence
  Description of Artificial Sequence: Synthetic spacer oligonucleotide
acggcattttagatttagcgatcatgctgccaac

SEQ ID NO: 297 - DNA, 33 bp, Artificial Sequence
  Description of Artificial Sequence: Synthetic spacer oligonucleotide
acgatcatgcgctggttagtgcggcgctcatct

SEQ ID NO: 298 - DNA, 34 bp, Artificial Sequence
  Description of Artificial Sequence: Synthetic spacer oligonucleotide
actttcataattcgccttattgtttaaatacaaa

SEQ ID NO: 299 - DNA, 34 bp, Artificial Sequence
  Description of Artificial Sequence: Synthetic spacer oligonucleotide
acttcaaagtgaattgcaaaagcacaaattgtcc

SEQ ID NO: 300 - DNA, 34 bp, Artificial Sequence
  Description of Artificial Sequence: Synthetic spacer oligonucleotide
acttcaaagtgaattgcaaaagcacaaattgtgc

SEQ ID NO: 301 - DNA, 34 bp, Artificial Sequence
  Description of Artificial Sequence: Synthetic spacer oligonucleotide
accccctaagcgcggatcgtatagttttttaccc

SEQ ID NO: 302 - DNA, 34 bp, Artificial Sequence
  Description of Artificial Sequence: Synthetic spacer oligonucleotide
acattggagatcacgttatgaaaacagctatcgc

SEQ ID NO: 303 - DNA, 34 bp, Artificial Sequence
  Description of Artificial Sequence: Synthetic spacer oligonucleotide
acaacttttgcttaaagctttccatgtactcatc

SEQ ID NO: 304 - DNA, 34 bp, Artificial Sequence
  Description of Artificial Sequence: Synthetic spacer oligonucleotide
actttgtttttgtgctgtcagtgatggcggcgtg

SEQ ID NO: 305 - DNA, 34 bp, Artificial Sequence
  Description of Artificial Sequence: Synthetic spacer oligonucleotide
acgtgaagactgcctgtttgcggtgcgtggcaaa

SEQ ID NO: 306 - DNA, 34 bp, Artificial Sequence
  Description of Artificial Sequence: Synthetic spacer oligonucleotide
acaaggctctgtcattccacctttgagtgttaga

SEQ ID NO: 307 - DNA, 34 bp, Artificial Sequence
  Description of Artificial Sequence: Synthetic spacer oligonucleotide
accctgaatactcgcagcgatttgcgcgatctgg

SEQ ID NO: 308 - DNA, 35 bp, Artificial Sequence
  Description of Artificial Sequence: Synthetic spacer oligonucleotide
acactggaaatactctggagtaccgggatcaggcg

SEQ ID NO: 309 - DNA, 34 bp, Artificial Sequence
  Description of Artificial Sequence: Synthetic spacer oligonucleotide
actttgcttcgttattcgatatcatatatattcg

SEQ ID NO: 310 - DNA, 34 bp, Artificial Sequence
  Description of Artificial Sequence: Synthetic spacer oligonucleotide
accagtaatcaatgcccgatatagaattatcggg

SEQ ID NO: 311 - DNA, 34 bp, Artificial Sequence
  Description of Artificial Sequence: Synthetic spacer oligonucleotide
accgcagcgttttcgccagtacggtgatatcgtt

SEQ ID NO: 312 - DNA, 34 bp, Artificial Sequence
  Description of Artificial Sequence: Synthetic spacer oligonucleotide
acaacccctcaatagacggcgctgattccgggcg

SEQ ID NO: 313 - DNA, 35 bp, Artificial Sequence
  Description of Artificial Sequence: Synthetic spacer oligonucleotide
acggctgcgtccgaacccggttatgtgctgccagt

SEQ ID NO: 314 - DNA, 34 bp, Artificial Sequence
  Description of Artificial Sequence: Synthetic spacer oligonucleotide
acttccagtcgtcgccggacgtcatgtcaatcag

SEQ ID NO: 315 - DNA, 34 bp, Artificial Sequence
  Description of Artificial Sequence: Synthetic spacer oligonucleotide
acacatgccgagtcgtgaggcgacggttatagac

SEQ ID NO: 316 - DNA, 34 bp, Artificial Sequence
  Description of Artificial Sequence: Synthetic spacer oligonucleotide
accaggttagatttctgcgcctccgccatcgtct

SEQ ID NO: 317 - DNA, 34 bp, Artificial Sequence
  Description of Artificial Sequence: Synthetic spacer oligonucleotide
accattgcgttgtgagcgcattgagttgattact

SEQ ID NO: 318 - DNA, 34 bp, Artificial Sequence
  Description of Artificial Sequence: Synthetic spacer oligonucleotide
acggcggcgcagtccagcgcggtagcggcagaga

SEQ ID NO: 319 - DNA, 34 bp, Artificial Sequence
  Description of Artificial Sequence: Synthetic spacer oligonucleotide
acatttcgtcgtgatttaagttgcagtagtcacg

SEQ ID NO: 320 - DNA, 34 bp, Artificial Sequence
  Description of Artificial Sequence: Synthetic spacer oligonucleotide
actttcgctgcttcagcattccccctgttaacag

SEQ ID NO: 321 - DNA, 34 bp, Artificial Sequence
  Description of Artificial Sequence: Synthetic spacer oligonucleotide
acctccagctcggctttttgctgcgctgcgcgtt

SEQ ID NO: 322 - DNA, 34 bp, Artificial Sequence
  Description of Artificial Sequence: Synthetic spacer oligonucleotide
accttcccttttttggttgctgagtcggcctctc

SEQ ID NO: 323 - DNA, 34 bp, Artificial Sequence
  Description of Artificial Sequence: Synthetic spacer oligonucleotide
acttctccggcatttccccgttgttgaacgcagc

SEQ ID NO: 324 - DNA, 34 bp, Artificial Sequence
  Description of Artificial Sequence: Synthetic spacer oligonucleotide
actacatcatcggctcaatgcgtaattctaaaat

SEQ ID NO: 325 - DNA, 35 bp, Artificial Sequence
  Description of Artificial Sequence: Synthetic spacer oligonucleotide
acatcatttcagcggaagtatttcaaattgtcagg

SEQ ID NO: 326 - DNA, 34 bp, Artificial Sequence
  Description of Artificial Sequence: Synthetic spacer oligonucleotide
acatcatttcagcggagtatttcaaattgtcagg

SEQ ID NO: 327 - DNA, 34 bp, Artificial Sequence
  Description of Artificial Sequence: Synthetic spacer oligonucleotide
accttgcggggcgttcaggtcagtaatgatgcgg

SEQ ID NO: 328 - DNA, 34 bp, Artificial Sequence
  Description of Artificial Sequence: Synthetic spacer oligonucleotide
acagcttccgccccccgccccggcccggcgttgt

SEQ ID NO: 329 - DNA, 34 bp, Artificial Sequence
  Description of Artificial Sequence: Synthetic spacer oligonucleotide
actacaagcggctctggtcgctgatgcaaaaaga

SEQ ID NO: 330 - DNA, 34 bp, Artificial Sequence
  Description of Artificial Sequence: Synthetic spacer oligonucleotide
acctgggcggcaacttcacacgtcacgatggtta

SEQ ID NO: 331 - DNA, 34 bp, Artificial Sequence
  Description of Artificial Sequence: Synthetic spacer oligonucleotide
acgtgagtgaacgtaatgtcgaatgacggcgagg

SEQ ID NO: 332 - DNA, 34 bp, Artificial Sequence
  Description of Artificial Sequence: Synthetic spacer oligonucleotide
acgacgacatgcaaaaacgcctggcgacgatgtt

SEQ ID NO: 333 - DNA, 34 bp, Artificial Sequence
  Description of Artificial Sequence: Synthetic spacer oligonucleotide
acgttctatttaacataatgaccgttacgcgcat

SEQ ID NO: 334 - DNA, 34 bp, Artificial Sequence
  Description of Artificial Sequence: Synthetic spacer oligonucleotide
acgtttgcccctgctatgaagaacattctcactc

SEQ ID NO: 335 - DNA, 34 bp, Artificial Sequence
  Description of Artificial Sequence: Synthetic spacer oligonucleotide
acctggcgcgtaacctgccgtttgcctcatatca

SEQ ID NO: 336 - DNA, 34 bp, Artificial Sequence
  Description of Artificial Sequence: Synthetic spacer oligonucleotide
actatccactccggcacacatcaccgctcgtcaa

SEQ ID NO: 337 - DNA, 34 bp, Artificial Sequence
  Description of Artificial Sequence: Synthetic spacer oligonucleotide
accacgtgaaccgatttacccggcaggccgttga

SEQ ID NO: 338 - DNA, 34 bp, Artificial Sequence
  Description of Artificial Sequence: Synthetic spacer oligonucleotide
acgaccacagtaacttcagcagcctgaccggcag

SEQ ID NO: 339 - DNA, 34 bp, Artificial Sequence
  Description of Artificial Sequence: Synthetic spacer oligonucleotide
acttatcggggacattaccgggaggcgaaatctg

SEQ ID NO: 340 - DNA, 34 bp, Artificial Sequence
  Description of Artificial Sequence: Synthetic spacer oligonucleotide
acatcgaccttcccatacagatcgagtttattac

SEQ ID NO: 341 - DNA, 34 bp, Artificial Sequence
  Description of Artificial Sequence: Synthetic spacer oligonucleotide
acgcgctcagtgttggggttgctgctgttggact

SEQ ID NO: 342 - DNA, 34 bp, Artificial Sequence
  Description of Artificial Sequence: Synthetic spacer oligonucleotide
accgtaacctaaatcaatgctcaaggtcgtccac

SEQ ID NO: 343 - DNA, 34 bp, Artificial Sequence
  Description of Artificial Sequence: Synthetic spacer oligonucleotide
accccacgacaaacaaaggaatctcaatgtaagc

SEQ ID NO: 344 - DNA, 34 bp, Artificial Sequence
  Description of Artificial Sequence: Synthetic spacer oligonucleotide
actctaccagggtacgaagctgagcggcggtaaa

SEQ ID NO: 345 - DNA, 34 bp, Artificial Sequence
  Description of Artificial Sequence: Synthetic spacer oligonucleotide
acggattatatgtcacagacaacaattacactgg

SEQ ID NO: 346 - DNA, 34 bp, Artificial Sequence
  Description of Artificial Sequence: Synthetic spacer oligonucleotide
acaccaatacccagaacaatacctatcaacgcgc

SEQ ID NO: 347 - DNA, 34 bp, Artificial Sequence
  Description of Artificial Sequence: Synthetic spacer oligonucleotide
actaacgatgcgtcgtggtggtatctccagacac

SEQ ID NO: 348 - DNA, 34 bp, Artificial Sequence
  Description of Artificial Sequence: Synthetic spacer oligonucleotide
acttttctgcatacatagtcgcattatttgtaat

SEQ ID NO: 349 - DNA, 34 bp, Artificial Sequence
  Description of Artificial Sequence: Synthetic spacer oligonucleotide
acgcgtagaagctgttgacgtcagcgagcgcaaa

SEQ ID NO: 350 - DNA, 34 bp, Artificial Sequence
  Description of Artificial Sequence: Synthetic spacer oligonucleotide
actgcatcgcccgtggtgctgcgggtgtttctcc

SEQ ID NO: 351 - DNA, 34 bp, Artificial Sequence
  Description of Artificial Sequence: Synthetic spacer oligonucleotide
accattttttatctcccaccagacgctgaccccg

SEQ ID NO: 352 - DNA, 34 bp, Artificial Sequence
  Description of Artificial Sequence: Synthetic spacer oligonucleotide
actagcgcgacgcagatagcggatgtaaaggctg

SEQ ID NO: 353 - DNA, 34 bp, Artificial Sequence
  Description of Artificial Sequence: Synthetic spacer oligonucleotide
acaaaagatggaactactccgataaacgcatctc

SEQ ID NO: 354 - DNA, 34 bp, Artificial Sequence
  Description of Artificial Sequence: Synthetic spacer oligonucleotide
acaaagcagtcaaacagatcgtcgtcctggtttt

SEQ ID NO: 355 - DNA, 34 bp, Artificial Sequence
  Description of Artificial Sequence: Synthetic spacer oligonucleotide
actccctccatatcctcttccgttggcgttaggc

SEQ ID NO: 356 - DNA, 34 bp, Artificial Sequence
  Description of Artificial Sequence: Synthetic spacer oligonucleotide
acttaatcgtcgatacaaggttttcgtagccctg

SEQ ID NO: 357 - DNA, 34 bp, Artificial Sequence
  Description of Artificial Sequence: Synthetic spacer oligonucleotide
accaaggcgcatctcaaaagccgccagcatgttg

SEQ ID NO: 358 - DNA, 34 bp, Artificial Sequence
  Description of Artificial Sequence: Synthetic spacer oligonucleotide
acgaagggctggcccttgccgaagtcctggaaat

SEQ ID NO: 359 - DNA, 34 bp, Artificial Sequence
  Description of Artificial Sequence: Synthetic spacer oligonucleotide
actctggaaaagagaaggttatttatgatttatc

SEQ ID NO: 360 - DNA, 34 bp, Artificial Sequence
  Description of Artificial Sequence: Synthetic spacer oligonucleotide
acgtattatagcgggtaattgaggagaaaatcat

SEQ ID NO: 361 - DNA, 34 bp, Artificial Sequence
  Description of Artificial Sequence: Synthetic spacer oligonucleotide
accccgcaacgggtaacgttaccgttgaattcac

SEQ ID NO: 362 - DNA, 34 bp, Artificial Sequence
  Description of Artificial Sequence: Synthetic spacer oligonucleotide
actcaagcgatactttgaatccgtggattggcgg

SEQ ID NO: 363 - DNA, 34 bp, Artificial Sequence
  Description of Artificial Sequence: Synthetic spacer oligonucleotide
acatttctccgttaaaaatcattccgcgctcttt

SEQ ID NO: 364 - DNA, 34 bp, Artificial Sequence
  Description of Artificial Sequence: Synthetic spacer oligonucleotide
acaacgaatggaccttttacaatctttgctttca

SEQ ID NO: 365 - DNA, 34 bp, Artificial Sequence
  Description of Artificial Sequence: Synthetic spacer oligonucleotide
accttgttatctgccagccaggtttttttcatcg

SEQ ID NO: 366 - DNA, 35 bp, Artificial Sequence
  Description of Artificial Sequence: Synthetic spacer oligonucleotide
acgcggttagcggctgcacgtttcgtttcggaaaa

SEQ ID NO: 367 - DNA, 34 bp, Artificial Sequence
  Description of Artificial Sequence: Synthetic spacer oligonucleotide
acatcccagcagtcgcagaacggcagtaaatgtc

SEQ ID NO: 368 - DNA, 34 bp, Artificial Sequence
  Description of Artificial Sequence: Synthetic spacer oligonucleotide
actgggtcaggatgaaggcgcaaaaatcctcacg

SEQ ID NO: 369 - DNA, 34 bp, Artificial Sequence
  Description of Artificial Sequence: Synthetic spacer oligonucleotide
acgggactcgattgggtcaggcaatcagcatttt

SEQ ID NO: 370 - DNA, 34 bp, Artificial Sequence
  Description of Artificial Sequence: Synthetic spacer oligonucleotide
accaattccagcatgattgtcacgacagatgaca

SEQ ID NO: 371 - DNA, 34 bp, Artificial Sequence
  Description of Artificial Sequence: Synthetic spacer oligonucleotide
acaatggcggtttatgtgcaactggttaaggatg

SEQ ID NO: 372 - DNA, 34 bp, Artificial Sequence
  Description of Artificial Sequence: Synthetic spacer oligonucleotide
acatgtgctgaccgaacgcctggcccgtcagaca

SEQ ID NO: 373 - DNA, 34 bp, Artificial Sequence
  Description of Artificial Sequence: Synthetic spacer oligonucleotide
acatcttttcacaaatagaaaaaaccatctgaaa

SEQ ID NO: 374 - DNA, 34 bp, Artificial Sequence
  Description of Artificial Sequence: Synthetic spacer oligonucleotide
acgaagcggtggcggctcagtatcagaatgtggc

SEQ ID NO: 375 - DNA, 34 bp, Artificial Sequence
  Description of Artificial Sequence: Synthetic spacer oligonucleotide
acggttgcagagttaaagggattcccgctggtgg

SEQ ID NO: 376 - DNA, 34 bp, Artificial Sequence
  Description of Artificial Sequence: Synthetic spacer oligonucleotide
acgataacctgaaatccacgcagctgctgagcgt

SEQ ID NO: 377 - DNA, 34 bp, Artificial Sequence
  Description of Artificial Sequence: Synthetic spacer oligonucleotide
actccaggtcttttggcgttaagccctgctgttc

SEQ ID NO: 378 - DNA, 34 bp, Artificial Sequence
  Description of Artificial Sequence: Synthetic spacer oligonucleotide
acggatttttcttgaacgtgatttcgggatacgc

SEQ ID NO: 379 - DNA, 34 bp, Artificial Sequence
  Description of Artificial Sequence: Synthetic spacer oligonucleotide
actatttataagcgtgtcatctatgcaacccaac

SEQ ID NO: 380 - DNA, 34 bp, Artificial Sequence
  Description of Artificial Sequence: Synthetic spacer oligonucleotide
acacctgcccgacccaataagggggccctcgtga

SEQ ID NO: 381 - DNA, 34 bp, Artificial Sequence
  Description of Artificial Sequence: Synthetic spacer oligonucleotide
acacctgcccgacccaataaggaggccctcgtga

SEQ ID NO: 382 - DNA, 34 bp, Artificial Sequence
  Description of Artificial Sequence: Synthetic spacer oligonucleotide
acacctgcccgacccaataagggggcccgcgtga

SEQ ID NO: 383 - DNA, 34 bp, Artificial Sequence
  Description of Artificial Sequence: Synthetic spacer oligonucleotide
acggccgctggtcaaattcccaatctgagcaatc

SEQ ID NO: 384 - DNA, 34 bp, Artificial Sequence
  Description of Artificial Sequence: Synthetic spacer oligonucleotide
acatagccccggcagcgatagctaaaccagttcc

SEQ ID NO: 385 - DNA, 34 bp, Artificial Sequence
  Description of Artificial Sequence: Synthetic spacer oligonucleotide
acgcctcaaaatctctcggtgagatgtaagcgtc

SEQ ID NO: 386 - DNA, 34 bp, Artificial Sequence
  Description of Artificial Sequence: Synthetic spacer oligonucleotide
actcctcaaaatctctcggtgagatgtaagcgtc

SEQ ID NO: 387 - DNA, 34 bp, Artificial Sequence
  Description of Artificial Sequence: Synthetic spacer oligonucleotide
acaccagtggtcagcggcggatgaatttgccctg

SEQ ID NO: 388 - DNA, 34 bp, Artificial Sequence
  Description of Artificial Sequence: Synthetic spacer oligonucleotide
acaccagtgatcagcggcggatgaatttgccctg

SEQ ID NO: 389 - DNA, 34 bp, Artificial Sequence
  Description of Artificial Sequence: Synthetic spacer oligonucleotide
acgagaatgctcatgcgcgtgagcgccatatatt

SEQ ID NO: 390 - DNA, 34 bp, Artificial Sequence
  Description of Artificial Sequence: Synthetic spacer oligonucleotide
acaggcggaccgaaaaaccgttttcagccaacgt

SEQ ID NO: 391 - DNA, 34 bp, Artificial Sequence
  Description of Artificial Sequence: Synthetic spacer oligonucleotide
accatggcaattttacggcggacgtgctcgctct

SEQ ID NO: 392 - DNA, 34 bp, Artificial Sequence
  Description of Artificial Sequence: Synthetic spacer oligonucleotide
acggctacacgcaaaaattccagtcgttggcgca

SEQ ID NO: 393 - DNA, 34 bp, Artificial Sequence
  Description of Artificial Sequence: Synthetic spacer oligonucleotide
acccgattaagatccgcagtctgcatcagtaact

SEQ ID NO: 394 - DNA, 34 bp, Artificial Sequence
  Description of Artificial Sequence: Synthetic spacer oligonucleotide
acggttcaggattcagcccccaccgaaaccggcg

SEQ ID NO: 395 - DNA, 34 bp, Artificial Sequence
  Description of Artificial Sequence: Synthetic spacer oligonucleotide
acattacttaacaaagaatcatatcgttgctgta

SEQ ID NO: 396 - DNA, 34 bp, Artificial Sequence
  Description of Artificial Sequence: Synthetic spacer oligonucleotide
accaccacgacgcataagaggcaacgcaatgctc

SEQ ID NO: 397 - DNA, 34 bp, Artificial Sequence
  Description of Artificial Sequence: Synthetic spacer oligonucleotide
acttcaacctggcgcagatcgctatcgaggaatt

SEQ ID NO: 398 - DNA, 34 bp, Artificial Sequence
  Description of Artificial Sequence: Synthetic spacer oligonucleotide
acttaatgaagttggagactgtgggtgtgatctc

SEQ ID NO: 399 - DNA, 34 bp, Artificial Sequence
  Description of Artificial Sequence: Synthetic spacer oligonucleotide
actttatttaaaaaaggcatacggattatgaatc

SEQ ID NO: 400 - DNA, 34 bp, Artificial Sequence
  Description of Artificial Sequence: Synthetic spacer oligonucleotide
acccgacaactgaaaccgcgcaaagtgatgctct

SEQ ID NO: 401 - DNA, 34 bp, Artificial Sequence
  Description of Artificial Sequence: Synthetic spacer oligonucleotide
actcaagctggctaatctgcgtgttgatgttgtc

SEQ ID NO: 402 - DNA, 34 bp, Artificial Sequence
  Description of Artificial Sequence: Synthetic spacer oligonucleotide
acaccacggcagaccctgtgtcacgtctaaccac

SEQ ID NO: 403 - DNA, 34 bp, Artificial Sequence
  Description of Artificial Sequence: Synthetic spacer oligonucleotide
accgaaaatcagcccgcatattccgacacatcgc

SEQ ID NO: 404 - DNA, 34 bp, Artificial Sequence
  Description of Artificial Sequence: Synthetic spacer oligonucleotide
accgattctacggcaacaggccaggctgcgaccg

SEQ ID NO: 405 - DNA, 34 bp, Artificial Sequence
  Description of Artificial Sequence: Synthetic spacer oligonucleotide
acccgacacatccacggccagcgacatgggggcc

SEQ ID NO: 406 - DNA, 34 bp, Artificial Sequence
  Description of Artificial Sequence: Synthetic spacer oligonucleotide
acgtgcaggcgactggaaaagacgatatatacgc

SEQ ID NO: 407 - DNA, 34 bp, Artificial Sequence
  Description of Artificial Sequence: Synthetic spacer oligonucleotide
acatcaaacatggaaacccctttaatgagagcaa

SEQ ID NO: 408 - DNA, 35 bp, Artificial Sequence
  Description of Artificial Sequence: Synthetic spacer oligonucleotide
actcaggaacgcgcggcggaagagcttggtgtttg

SEQ ID NO: 409 - DNA, 34 bp, Artificial Sequence
  Description of Artificial Sequence: Synthetic spacer oligonucleotide
acgctgcctttcccggagttccggcccctaaatt

SEQ ID NO: 410 - DNA, 34 bp, Artificial Sequence
  Description of Artificial Sequence: Synthetic spacer oligonucleotide
actcatgcgctataaaaatcagactgtcacatgc

SEQ ID NO: 411 - DNA, 34 bp, Artificial Sequence
  Description of Artificial Sequence: Synthetic spacer oligonucleotide
actgattattgacgacaacagcacagaccggcag

SEQ ID NO: 412 - DNA, 34 bp, Artificial Sequence
  Description of Artificial Sequence: Synthetic spacer oligonucleotide
acaataatcggcaatttgtcctggacaggcacgg

SEQ ID NO: 413 - DNA, 34 bp, Artificial Sequence
  Description of Artificial Sequence: Synthetic spacer oligonucleotide
acgaatctggaggccaacagcgcggcgaaatcct

SEQ ID NO: 414 - DNA, 34 bp, Artificial Sequence
  Description of Artificial Sequence: Synthetic spacer oligonucleotide
acgtggccgggttgagtaccgatcgcattttttt

SEQ ID NO: 415 - DNA, 34 bp, Artificial Sequence
  Description of Artificial Sequence: Synthetic spacer oligonucleotide
acttcccctccggatggcggggatgctcttatgg

SEQ ID NO: 416 - DNA, 34 bp, Artificial Sequence
  Description of Artificial Sequence: Synthetic spacer oligonucleotide
actgacgctattggcgatgcgctgacctacggag

SEQ ID NO: 417 - DNA, 34 bp, Artificial Sequence
  Description of Artificial Sequence: Synthetic spacer oligonucleotide
actaatcactgaacgtgacgtctatgccaacgcc

SEQ ID NO: 418 - DNA, 34 bp, Artificial Sequence
  Description of Artificial Sequence: Synthetic spacer oligonucleotide
actagcaataattaaaacgagaggcgaaaatttt

SEQ ID NO: 419 - DNA, 34 bp, Artificial Sequence
  Description of Artificial Sequence: Synthetic spacer oligonucleotide
acgtgtgttctggagaaggtgaacgacaagtagc

SEQ ID NO: 420 - DNA, 34 bp, Artificial Sequence
  Description of Artificial Sequence: Synthetic spacer oligonucleotide
acctgttaagaaattcactaccacccgcgtggcg

SEQ ID NO: 421 - DNA, 34 bp, Artificial Sequence
  Description of Artificial Sequence: Synthetic spacer oligonucleotide
acactttacatcattagctatgtccaaatcatac

SEQ ID NO: 422 - DNA, 35 bp, Artificial Sequence
  Description of Artificial Sequence: Synthetic spacer oligonucleotide
acgataagaacgtgaccgtcaacgcaatctaatgc

SEQ ID NO: 423 - DNA, 35 bp, Artificial Sequence
  Description of Artificial Sequence: Synthetic spacer oligonucleotide
acaaagaaagcgtttggggtgatctgacgcacggc

SEQ ID NO: 424 - DNA, 34 bp, Artificial Sequence
  Description of Artificial Sequence: Synthetic spacer oligonucleotide
actgatttccctgttttgttcgttttagttaacg

SEQ ID NO: 425 - DNA, 34 bp, Artificial Sequence
  Description of Artificial Sequence: Synthetic spacer oligonucleotide
acactgctacagcaataagaatagcgatttcaaa

SEQ ID NO: 426 - DNA, 34 bp, Artificial Sequence
  Description of Artificial Sequence: Synthetic spacer oligonucleotide
accaggtgctcgctatgatgtttatcttgatggg

SEQ ID NO: 427 - DNA, 34 bp, Artificial Sequence
  Description of Artificial Sequence: Synthetic spacer oligonucleotide
atgcgcacgcgatatttccctgttgagtggccag

SEQ ID NO: 428 - DNA, 34 bp, Artificial Sequence
  Description of Artificial Sequence: Synthetic spacer oligonucleotide
acgtggcgctaaacgttgccagcccctcatcatt

SEQ ID NO: 429 - DNA, 34 bp, Artificial Sequence
  Description of Artificial Sequence: Synthetic spacer oligonucleotide
acatgtcttcaagatgatcggcaattatctcagc

SEQ ID NO: 430 - DNA, 34 bp, Artificial Sequence
  Description of Artificial Sequence: Synthetic spacer oligonucleotide
acagtgagttaatttattgtcgcggcggctgtgg

SEQ ID NO: 431 - DNA, 34 bp, Artificial Sequence
  Description of Artificial Sequence: Synthetic spacer oligonucleotide
acgatgcgtagtccagccggtcgtaagtcctgtc

SEQ ID NO: 432 - DNA, 34 bp, Artificial Sequence
  Description of Artificial Sequence: Synthetic spacer oligonucleotide
acagcattggcgttttccgttgcgtcaatggctt

SEQ ID NO: 433 - DNA, 34 bp, Artificial Sequence
  Description of Artificial Sequence: Synthetic spacer oligonucleotide
accatttccagagaaatagccgtgataatgccgt

SEQ ID NO: 434 - DNA, 34 bp, Artificial Sequence
  Description of Artificial Sequence: Synthetic spacer oligonucleotide
acatagaaaccgctggagaacagagatgaactat

SEQ ID NO: 435 - DNA, 34 bp, Artificial Sequence
  Description of Artificial Sequence: Synthetic spacer oligonucleotide
acttgaaaaaaaattcattgtcgtcaatcatatg

SEQ ID NO: 436 - DNA, 34 bp, Artificial Sequence
  Description of Artificial Sequence: Synthetic spacer oligonucleotide
acgccaactgaaatgttgcaagttgatttcgggc

SEQ ID NO: 437 - DNA, 34 bp, Artificial Sequence
  Description of Artificial Sequence: Synthetic spacer oligonucleotide
acgggaggatcgcccgggactcccgcgcccggcg

SEQ ID NO: 438 - DNA, 34 bp, Artificial Sequence
  Description of Artificial Sequence: Synthetic spacer oligonucleotide
accatggcccgtctctcgctgtatgcggggggcg

SEQ ID NO: 439 - DNA, 34 bp, Artificial Sequence
  Description of Artificial Sequence: Synthetic spacer oligonucleotide
acttgatccgtttgcagctcaatggctgcgcaac

SEQ ID NO: 440 - DNA, 34 bp, Artificial Sequence
  Description of Artificial Sequence: Synthetic spacer oligonucleotide
acgcacgccctgctcgtcgttgttaatacgcggg

SEQ ID NO: 441 - DNA, 34 bp, Artificial Sequence
  Description of Artificial Sequence: Synthetic spacer oligonucleotide
acacgaacaggaatgccagacgatggaagcgtcg

SEQ ID NO: 442 - DNA, 32 bp, Artificial Sequence
  Description of Artificial Sequence: Synthetic spacer oligonucleotide
acacccctttaatctgttcattgctccagcca

SEQ ID NO: 443 - DNA, 32 bp, Artificial Sequence
  Description of Artificial Sequence: Synthetic spacer oligonucleotide
ccccctttaatctgttcattgctccagccacg

SEQ ID NO: 444 - DNA, 34 bp, Artificial Sequence
  Description of Artificial Sequence: Synthetic spacer oligonucleotide
acaaattgcaatccccccacgccactggtcagac

SEQ ID NO: 445 - DNA, 34 bp, Artificial Sequence
  Description of Artificial Sequence: Synthetic spacer oligonucleotide
acgcaggatgaccggcggctggttctcctgcgtt

SEQ ID NO: 446 - DNA, 34 bp, Artificial Sequence
  Description of Artificial Sequence: Synthetic spacer oligonucleotide
acgcaggaggaccggcggctggttctcctgcgtt

SEQ ID NO: 447 - DNA, 34 bp, Artificial Sequence
  Description of Artificial Sequence: Synthetic spacer oligonucleotide
actctcttgtcccgcagaattcatctggcgtctc

SEQ ID NO: 448 - DNA, 34 bp, Artificial Sequence
  Description of Artificial Sequence: Synthetic spacer oligonucleotide
acgatgagcaacacgcccgcactggcgtaactta

SEQ ID NO: 449 - DNA, 34 bp, Artificial Sequence
  Description of Artificial Sequence: Synthetic spacer oligonucleotide
acatatccagcctgcgatagagatagttttccgg

SEQ ID NO: 450 - DNA, 34 bp, Artificial Sequence
  Description of Artificial Sequence: Synthetic spacer oligonucleotide
acttttcagctcgccgcagaatatcagtgaggcg

SEQ ID NO: 451 - DNA, 34 bp, Artificial Sequence
  Description of Artificial Sequence: Synthetic spacer oligonucleotide
accaatatttatattttgtctgttgtacggtttt

SEQ ID NO: 452 - DNA, 34 bp, Artificial Sequence
  Description of Artificial Sequence: Synthetic spacer oligonucleotide
actgaatcaggttcatgctcaaaactgaaatgtc

SEQ ID NO: 453 - DNA, 34 bp, Artificial Sequence
  Description of Artificial Sequence: Synthetic spacer oligonucleotide
acgtgttgtttaacgggattctttaaaatgaccg

SEQ ID NO: 454 - DNA, 34 bp, Artificial Sequence
  Description of Artificial Sequence: Synthetic spacer oligonucleotide
acttcgtcgtcgccattatcgagaacatcccatt

SEQ ID NO: 455 - DNA, 34 bp, Artificial Sequence
  Description of Artificial Sequence: Synthetic spacer oligonucleotide
acgggcggtccccggcctcaataccgcgctgacg

SEQ ID NO: 456 - DNA, 34 bp, Artificial Sequence
  Description of Artificial Sequence: Synthetic spacer oligonucleotide
acggaaaccgactgcataccctgcgcaatgaaag

SEQ ID NO: 457 - DNA, 34 bp, Artificial Sequence
  Description of Artificial Sequence: Synthetic spacer oligonucleotide
acgagtgggtacagacggataagcggttcgatgc

SEQ ID NO: 458 - DNA, 34 bp, Artificial Sequence
  Description of Artificial Sequence: Synthetic spacer oligonucleotide
acgtcgtctttcattttagaaaggcgattcatta

SEQ ID NO: 459 - DNA, 34 bp, Artificial Sequence
  Description of Artificial Sequence: Synthetic spacer oligonucleotide
acatcagcgccagccggttttcggctacaaacga

SEQ ID NO: 460 - DNA, 34 bp, Artificial Sequence
  Description of Artificial Sequence: Synthetic spacer oligonucleotide
accattggcatatcagtaccgaatgacgccatga

SEQ ID NO: 461 - DNA, 34 bp, Artificial Sequence
  Description of Artificial Sequence: Synthetic spacer oligonucleotide
acctttgaaacggtagcggttcggcactccacca

SEQ ID NO: 462 - DNA, 34 bp, Artificial Sequence
  Description of Artificial Sequence: Synthetic spacer oligonucleotide
accgttctggtctcttgcgtagcatgaaacattg

SEQ ID NO: 463 - DNA, 34 bp, Artificial Sequence
  Description of Artificial Sequence: Synthetic spacer oligonucleotide
acttaaaagcggtcgcgccgcaatgtggctggag

SEQ ID NO: 464 - DNA, 34 bp, Artificial Sequence
  Description of Artificial Sequence: Synthetic spacer oligonucleotide
accagatagaatgaaaaatagattttgatgtcgc

SEQ ID NO: 465 - DNA, 34 bp, Artificial Sequence
  Description of Artificial Sequence: Synthetic spacer oligonucleotide
accgcaacaattgccagaatgctggagttaagtt

SEQ ID NO: 466 - DNA, 34 bp, Artificial Sequence
  Description of Artificial Sequence: Synthetic spacer oligonucleotide
tcccagatcattggctggtcgttgcggcgctaga

SEQ ID NO: 467 - DNA, 34 bp, Artificial Sequence
  Description of Artificial Sequence: Synthetic spacer oligonucleotide
tctccagataaagctctgtcatgccgccgctatt

SEQ ID NO: 468 - DNA, 34 bp, Artificial Sequence
  Description of Artificial Sequence: Synthetic spacer oligonucleotide
tcgcaattcctgagattttacattctccagatcg

SEQ ID NO: 469 - DNA, 34 bp, Artificial Sequence
  Description of Artificial Sequence: Synthetic spacer oligonucleotide
tcgctggaggattgctacttcagccaaaagagtc

SEQ ID NO: 470 - DNA, 34 bp, Artificial Sequence
  Description of Artificial Sequence: Synthetic spacer oligonucleotide
tcggggacaggctaggcatctatttttttacctt

SEQ ID NO: 471 - DNA, 34 bp, Artificial Sequence
  Description of Artificial Sequence: Synthetic spacer oligonucleotide
tcacgatgtgacgatcgttggcgttgtgctacag

SEQ ID NO: 472 - DNA, 34 bp, Artificial Sequence
  Description of Artificial Sequence: Synthetic spacer oligonucleotide
tcggacctacggggcgcttggccatgcctcaatc

SEQ ID NO: 473 - DNA, 34 bp, Artificial Sequence
  Description of Artificial Sequence: Synthetic spacer oligonucleotide
tcgcccactcagccagccggcgatcgagactgcc

SEQ ID NO: 474 - DNA, 34 bp, Artificial Sequence
  Description of Artificial Sequence: Synthetic spacer oligonucleotide
tcccccatctgcataaattctgtctgacactctg

SEQ ID NO: 475 - DNA, 34 bp, Artificial Sequence
  Description of Artificial Sequence: Synthetic spacer oligonucleotide
tctctgcggcgctgctgacacccagttcagccgc

SEQ ID NO: 476 - DNA, 34 bp, Artificial Sequence
  Description of Artificial Sequence: Synthetic spacer oligonucleotide
tcctggtctgaaaggaatttatggcgacgatatt

SEQ ID NO: 477 - DNA, 34 bp, Artificial Sequence
  Description of Artificial Sequence: Synthetic spacer oligonucleotide
tccattctccctgtgagataccctaacccgctaa

SEQ ID NO: 478 - DNA, 34 bp, Artificial Sequence
  Description of Artificial Sequence: Synthetic spacer oligonucleotide
tctgaacttgaacggagttgagtgatagcccttg

SEQ ID NO: 479 - DNA, 34 bp, Artificial Sequence
  Description of Artificial Sequence: Synthetic spacer oligonucleotide
tcttcttccgatgctgctaacaaatgccaccagg

SEQ ID NO: 480 - DNA, 34 bp, Artificial Sequence
  Description of Artificial Sequence: Synthetic spacer oligonucleotide
tcttagcgttgcctggtctgctgccatcgttatg

SEQ ID NO: 481 - DNA, 34 bp, Artificial Sequence
  Description of Artificial Sequence: Synthetic spacer oligonucleotide
tcttggtcatctgtctgcccatagctgaacccgg

SEQ ID NO: 482 - DNA, 34 bp, Artificial Sequence
  Description of Artificial Sequence: Synthetic spacer oligonucleotide
tcgcggccgcattcctttacctcaacaggcactg

SEQ ID NO: 483 - DNA, 34 bp, Artificial Sequence
  Description of Artificial Sequence: Synthetic spacer oligonucleotide
tcttactgaggtgtgattgctgtcaccccaatag

SEQ ID NO: 484 - DNA, 34 bp, Artificial Sequence
  Description of Artificial Sequence: Synthetic spacer oligonucleotide
tcgaggcgcagcaagacagattaaagccattgtc

SEQ ID NO: 485 - DNA, 34 bp, Artificial Sequence
  Description of Artificial Sequence: Synthetic spacer oligonucleotide
tcgctaataaaccagaattaaaaatcgccgagct

SEQ ID NO: 486 - DNA, 34 bp, Artificial Sequence
  Description of Artificial Sequence: Synthetic spacer oligonucleotide
tctttcttttaatttcataagtggtggtgtatcg

SEQ ID NO: 487 - DNA, 34 bp, Artificial Sequence
  Description of Artificial Sequence: Synthetic spacer oligonucleotide
acgcggcaaccgcctctactgatggactgatttt

SEQ ID NO: 488 - DNA, 34 bp, Artificial Sequence
  Description of Artificial Sequence: Synthetic spacer oligonucleotide
acagggcatacagtcggatcatcacccacgccat

SEQ ID NO: 489 - DNA, 34 bp, Artificial Sequence
  Description of Artificial Sequence: Synthetic spacer oligonucleotide
actggctggtcgtcgtcatcacccgtcggctcct

SEQ ID NO: 490 - DNA, 34 bp, Artificial Sequence
  Description of Artificial Sequence: Synthetic spacer oligonucleotide
acagctgagttctgctatttgccgcatgttgagc

SEQ ID NO: 491 - DNA, 34 bp, Artificial Sequence
  Description of Artificial Sequence: Synthetic spacer oligonucleotide
accgcaaggtgaacaataaggcgctgtcagcaga

SEQ ID NO: 492 - DNA, 34 bp, Artificial Sequence
  Description of Artificial Sequence: Synthetic spacer oligonucleotide
acgaaaattcagagaaagcggcgcagacactgtt

SEQ ID NO: 493 - DNA, 34 bp, Artificial Sequence
  Description of Artificial Sequence: Synthetic spacer oligonucleotide
acctctgcgccgttgccgatttcgaccgtttgaa

SEQ ID NO: 494 - DNA, 34 bp, Artificial Sequence
  Description of Artificial Sequence: Synthetic spacer oligonucleotide
acttaaatagtccatccatcagtctcttaccagg

SEQ ID NO: 495 - DNA, 34 bp, Artificial Sequence
  Description of Artificial Sequence: Synthetic spacer oligonucleotide
acaactctcgcagaagagagtgtttatatatcgt

SEQ ID NO: 496 - DNA, 34 bp, Artificial Sequence
  Description of Artificial Sequence: Synthetic spacer oligonucleotide
acggccgcggcggcggtactgattgtcgctgttg

SEQ ID NO: 497 - DNA, 34 bp, Artificial Sequence
  Description of Artificial Sequence: Synthetic spacer oligonucleotide
accgaagcagttgctggttgcgaaatggaagagt

SEQ ID NO: 498 - DNA, 34 bp, Artificial Sequence
  Description of Artificial Sequence: Synthetic spacer oligonucleotide
acgcgcctatagagcaaatcgctgttgcggctaa

SEQ ID NO: 499 - DNA, 34 bp, Artificial Sequence
  Description of Artificial Sequence: Synthetic spacer oligonucleotide
acggccacgccgctgccgtatcagagccagccgg

SEQ ID NO: 500 - DNA, 34 bp, Artificial Sequence
  Description of Artificial Sequence: Synthetic spacer oligonucleotide
acttttgctggagaaattacagaatatcgcagcg

SEQ ID NO: 501 - DNA, 34 bp, Artificial Sequence
  Description of Artificial Sequence: Synthetic spacer oligonucleotide
acgagtatcagccaagcccgatgttaaagcgctc

SEQ ID NO: 502 - DNA, 34 bp, Artificial Sequence
  Description of Artificial Sequence: Synthetic spacer oligonucleotide
acatcagccagcgttacacggctatatctgcggg

SEQ ID NO: 503 - DNA, 34 bp, Artificial Sequence
  Description of Artificial Sequence: Synthetic spacer oligonucleotide
actggtatccgcgcattgggtaaaaatttgcttt

SEQ ID NO: 504 - DNA, 34 bp, Artificial Sequence
  Description of Artificial Sequence: Synthetic spacer oligonucleotide
acgcttcgagtgatggaaagacaggagttgtctt

SEQ ID NO: 505 - DNA, 34 bp, Artificial Sequence
  Description of Artificial Sequence: Synthetic spacer oligonucleotide
actgcactatttgcccatcttttatggttccaag

SEQ ID NO: 506 - DNA, 34 bp, Artificial Sequence
  Description of Artificial Sequence: Synthetic spacer oligonucleotide
actggcccggatgcggtcggacgaacccgtcgcc

SEQ ID NO: 507 - DNA, 34 bp, Artificial Sequence
  Description of Artificial Sequence: Synthetic spacer oligonucleotide
accaaatgcccccccccattacaaggacaaccgg

SEQ ID NO: 508 - DNA, 34 bp, Artificial Sequence
  Description of Artificial Sequence: Synthetic spacer oligonucleotide
acaaccagacggcgaccgtcacacaatgtgtgct

SEQ ID NO: 509 - DNA, 34 bp, Artificial Sequence
  Description of Artificial Sequence: Synthetic spacer oligonucleotide
acgtcgccgccttgagtcgatcgccgcgcgattt

SEQ ID NO: 510 - DNA, 34 bp, Artificial Sequence
  Description of Artificial Sequence: Synthetic spacer oligonucleotide
actcgttatcctgaatgatgatccggactccgaa

SEQ ID NO: 511 - DNA, 34 bp, Artificial Sequence
  Description of Artificial Sequence: Synthetic spacer oligonucleotide
acaaaaaccaggactttccttgtttccccggcca

SEQ ID NO: 512 - DNA, 34 bp, Artificial Sequence
  Description of Artificial Sequence: Synthetic spacer oligonucleotide
accgcaccgccatgctccggggtaatcacagaga

SEQ ID NO: 513 - DNA, 34 bp, Artificial Sequence
  Description of Artificial Sequence: Synthetic spacer oligonucleotide
acgcaataacagaacgatagtcactcacgatttt

SEQ ID NO: 514 - DNA, 34 bp, Artificial Sequence
  Description of Artificial Sequence: Synthetic spacer oligonucleotide
acttcaataccgttgtgagtggagatcaaacgaa

SEQ ID NO: 515 - DNA, 34 bp, Artificial Sequence
  Description of Artificial Sequence: Synthetic spacer oligonucleotide
acgttgcatttttcagcgccgcagtgtggacact

SEQ ID NO: 516 - DNA, 34 bp, Artificial Sequence
  Description of Artificial Sequence: Synthetic spacer oligonucleotide
actcaggccaccccagaaacgttcctgacgcgct

SEQ ID NO: 517 - DNA, 34 bp, Artificial Sequence
  Description of Artificial Sequence: Synthetic spacer oligonucleotide
acgcctcatccagcgccccaccatcagtaacacc

SEQ ID NO: 518 - DNA, 34 bp, Artificial Sequence
  Description of Artificial Sequence: Synthetic spacer oligonucleotide
acgtaatttattcctggatagtcgctaataaaat

SEQ ID NO: 519 - DNA, 34 bp, Artificial Sequence
  Description of Artificial Sequence: Synthetic spacer oligonucleotide
acatgacatgaccgtgactagcgagaatgtccca

SEQ ID NO: 520 - DNA, 34 bp, Artificial Sequence
  Description of Artificial Sequence: Synthetic spacer oligonucleotide
actgcccccacggtgactgcccggtaattttcgg

SEQ ID NO: 521 - DNA, 34 bp, Artificial Sequence
  Description of Artificial Sequence: Synthetic spacer oligonucleotide
actaatcagacccgttatcgcgcgtgccggtgat

SEQ ID NO: 522 - DNA, 34 bp, Artificial Sequence
  Description of Artificial Sequence: Synthetic spacer oligonucleotide
accgctgcgaccgggcgttctgctgcgcttcccg

SEQ ID NO: 523 - DNA, 34 bp, Artificial Sequence
  Description of Artificial Sequence: Synthetic spacer oligonucleotide
actttgtgtcatcgcccatatcgcagtggttaca

SEQ ID NO: 524 - DNA, 34 bp, Artificial Sequence
  Description of Artificial Sequence: Synthetic spacer oligonucleotide
acgggctggtggggacgtcaacaacctacgctga

SEQ ID NO: 525 - DNA, 34 bp, Artificial Sequence
  Description of Artificial Sequence: Synthetic spacer oligonucleotide
acgtacgtgcgttcgttgccgttctgatcaacgg

SEQ ID NO: 526 - DNA, 34 bp, Artificial Sequence
  Description of Artificial Sequence: Synthetic spacer oligonucleotide
accggatttttcttgaacgtgatttcgggatacg

SEQ ID NO: 527 - DNA, 35 bp, Artificial Sequence
  Description of Artificial Sequence: Synthetic spacer oligonucleotide
acgcttgacgaagcgaacaaatttacctgtttttg

SEQ ID NO: 528 - DNA, 34 bp, Artificial Sequence
  Description of Artificial Sequence: Synthetic spacer oligonucleotide
acttcagtgcgttatatccaccagacataaaagc

SEQ ID NO: 529 - DNA, 34 bp, Artificial Sequence
  Description of Artificial Sequence: Synthetic spacer oligonucleotide
acgacacaccgatagtgagaggttaccgatgggg

SEQ ID NO: 530 - DNA, 34 bp, Artificial Sequence
  Description of Artificial Sequence: Synthetic spacer oligonucleotide
acaccgattgcatccagccaaatatctggatcgt

SEQ ID NO: 531 - DNA, 34 bp, Artificial Sequence
  Description of Artificial Sequence: Synthetic spacer oligonucleotide
acatttcgtacccgtcttcattaatccaatcctg

SEQ ID NO: 532 - DNA, 34 bp, Artificial Sequence
  Description of Artificial Sequence: Synthetic spacer oligonucleotide
acttttcgccacaaaaaacgatcccgtcgccgtt

SEQ ID NO: 533 - DNA, 31 bp, Artificial Sequence
  Description of Artificial Sequence: Synthetic spacer oligonucleotide
accaaccccgccgccgcctgtatttaacaag

SEQ ID NO: 534 - DNA, 34 bp, Artificial Sequence
  Description of Artificial Sequence: Synthetic spacer oligonucleotide
accgaaacaggaaactaaataaatgaacgaaacg

SEQ ID NO: 535 - DNA, 34 bp, Artificial Sequence
  Description of Artificial Sequence: Synthetic spacer oligonucleotide
acgacggtggaaatcgctattgtccgcgagatgt

SEQ ID NO: 536 - DNA, 34 bp, Artificial Sequence
  Description of Artificial Sequence: Synthetic spacer oligonucleotide
acacgatccattttttcaggtcgaataaaacgcc

SEQ ID NO: 537 - DNA, 34 bp, Artificial Sequence
  Description of Artificial Sequence: Synthetic spacer oligonucleotide
acgcaccgccaccggtgcggctggccgtctcctg

SEQ ID NO: 538 - DNA, 34 bp, Artificial Sequence
  Description of Artificial Sequence: Synthetic spacer oligonucleotide
acacgcccggcaccgttgccagtccctgcgctac

SEQ ID NO: 539 - DNA, 34 bp, Artificial Sequence
  Description of Artificial Sequence: Synthetic spacer oligonucleotide
acgtcgttaccattgcgtcataggcgcggatcac

SEQ ID NO: 540 - DNA, 34 bp, Artificial Sequence
  Description of Artificial Sequence: Synthetic spacer oligonucleotide
acgcaggcggccatctcgacccccggcaatagag

SEQ ID NO: 541 - DNA, 34 bp, Artificial Sequence
  Description of Artificial Sequence: Synthetic spacer oligonucleotide
acaccgacagccaggtgacgaacgccaccaacga

SEQ ID NO: 542 - DNA, 34 bp, Artificial Sequence
  Description of Artificial Sequence: Synthetic spacer oligonucleotide
acacggcggtgaaaactcgggcaaaacggcattg

SEQ ID NO: 543 - DNA, 34 bp, Artificial Sequence
  Description of Artificial Sequence: Synthetic spacer oligonucleotide
acgctcacgcggcctttttattttgctactgtat

SEQ ID NO: 544 - DNA, 34 bp, Artificial Sequence
  Description of Artificial Sequence: Synthetic spacer oligonucleotide
acagatttcacaggtacgcatcgagtaatttatg

SEQ ID NO: 545 - DNA, 34 bp, Artificial Sequence
  Description of Artificial Sequence: Synthetic spacer oligonucleotide
acgattttgttcgctacgtcgccagccatgccaa

SEQ ID NO: 546 - DNA, 34 bp, Artificial Sequence
  Description of Artificial Sequence: Synthetic spacer oligonucleotide
acttggtcatggttgagacaaacgggcctggtag

SEQ ID NO: 547 - DNA, 34 bp, Artificial Sequence
  Description of Artificial Sequence: Synthetic spacer oligonucleotide
actcgccttcaggaagaaacctacatcgaacacg

SEQ ID NO: 548 - DNA, 34 bp, Artificial Sequence
  Description of Artificial Sequence: Synthetic spacer oligonucleotide
acctgcaattcgcgttctctggcctgtttcgcca

SEQ ID NO: 549 - DNA, 34 bp, Artificial Sequence
  Description of Artificial Sequence: Synthetic spacer oligonucleotide
acgctgacatggaaaccgtcgccggcaattgggc

SEQ ID NO: 550 - DNA, 35 bp, Artificial Sequence
  Description of Artificial Sequence: Synthetic spacer oligonucleotide
acgcggagaattatatatcggaatgttacaggaaa

SEQ ID NO: 551 - DNA, 34 bp, Artificial Sequence
  Description of Artificial Sequence: Synthetic spacer oligonucleotide
acgttaaatacaattcgcccgccattaaaatcaa

SEQ ID NO: 552 - DNA, 34 bp, Artificial Sequence
  Description of Artificial Sequence: Synthetic spacer oligonucleotide
acgtctgcatcgcgtacaatgcgcccgcatcgcc

SEQ ID NO: 553 - DNA, 34 bp, Artificial Sequence
  Description of Artificial Sequence: Synthetic spacer oligonucleotide
acgatgaattcagggggccagtttttgtaaaaat

SEQ ID NO: 554 - DNA, 34 bp, Artificial Sequence
  Description of Artificial Sequence: Synthetic spacer oligonucleotide
acgggttgaggggctttatatagtggtattccgc

SEQ ID NO: 555 - DNA, 34 bp, Artificial Sequence
  Description of Artificial Sequence: Synthetic spacer oligonucleotide
accatgtcagcgcgcggcccgacataatgccggt

SEQ ID NO: 556 - DNA, 34 bp, Artificial Sequence
  Description of Artificial Sequence: Synthetic spacer oligonucleotide
acctcagcatctaacgtgcggccaccgtcagcgg

SEQ ID NO: 557 - DNA, 74 bp, Artificial Sequence
  Description of Artificial Sequence: Synthetic spacer oligonucleotide
actggttcatgacgtataagctcatataccctgtcggtttatccccgctgcagcgctgtttaaatggctggccg

SEQ ID NO: 558 - DNA, 34 bp, Artificial Sequence
  Description of Artificial Sequence: Synthetic spacer oligonucleotide
actggggttacctgcactccagtcccggcaggta

SEQ ID NO: 559 - DNA, 34 bp, Artificial Sequence
  Description of Artificial Sequence: Synthetic spacer oligonucleotide
acatcagcggcactatcagcccaatttataagac

SEQ ID NO: 560 - DNA, 34 bp, Artificial Sequence
  Description of Artificial Sequence: Synthetic spacer oligonucleotide
actgttgctgccattgcggcgcagccctgccaag

SEQ ID NO: 561 - DNA, 34 bp, Artificial Sequence
  Description of Artificial Sequence: Synthetic spacer oligonucleotide
acgttaactattacgatccaacgcataacaacag

SEQ ID NO: 562 - DNA, 34 bp, Artificial Sequence
  Description of Artificial Sequence: Synthetic spacer oligonucleotide
actgctgccagcgtgaaatataattctgcaatct

SEQ ID NO: 563 - DNA, 34 bp, Artificial Sequence
  Description of Artificial Sequence: Synthetic spacer oligonucleotide
acttgatgaaagttcatctaataatgattgtgct

SEQ ID NO: 564 - DNA, 34 bp, Artificial Sequence
  Description of Artificial Sequence: Synthetic spacer oligonucleotide
actccgttgtgataacttcccacattgatgatcc

SEQ ID NO: 565 - DNA, 34 bp, Artificial Sequence
  Description of Artificial Sequence: Synthetic spacer oligonucleotide
actgcgtcccggtctaaatattcaccctcggcgt

SEQ ID NO: 566 - DNA, 34 bp, Artificial Sequence
  Description of Artificial Sequence: Synthetic spacer oligonucleotide
accaaaagcgaggtttccagcgagctaaaaccgg

SEQ ID NO: 567 - DNA, 34 bp, Artificial Sequence
  Description of Artificial Sequence: Synthetic spacer oligonucleotide
acaagtggcccttcgatccagtttgatgaaagtt

SEQ ID NO: 568 - DNA, 34 bp, Artificial Sequence
  Description of Artificial Sequence: Synthetic spacer oligonucleotide
actgcgtctttttcccgctggagttgaatattct

SEQ ID NO: 569 - DNA, 34 bp, Artificial Sequence
  Description of Artificial Sequence: Synthetic spacer oligonucleotide
acatgtcggcattatcggacgcgatctctgtttc

SEQ ID NO: 570 - DNA, 34 bp, Artificial Sequence
  Description of Artificial Sequence: Synthetic spacer oligonucleotide
acgcccgcccacggcgatcagaatcaatccacgc

SEQ ID NO: 571 - DNA, 34 bp, Artificial Sequence
  Description of Artificial Sequence: Synthetic spacer oligonucleotide
acccaaccacctcaacctccaggcggtcgatctg

SEQ ID NO: 572 - DNA, 34 bp, Artificial Sequence
  Description of Artificial Sequence: Synthetic spacer oligonucleotide
actaagggcgtgcgcactcagctcgtattggacg

SEQ ID NO: 573 - DNA, 34 bp, Artificial Sequence
  Description of Artificial Sequence: Synthetic spacer oligonucleotide
actgatgctggccaacaggagcgcccgcgggagc

SEQ ID NO: 574 - DNA, 34 bp, Artificial Sequence
  Description of Artificial Sequence: Synthetic spacer oligonucleotide
acgcgtattctcgcggcgttggctcccgatgagg

SEQ ID NO: 575 - DNA, 34 bp, Artificial Sequence
  Description of Artificial Sequence: Synthetic spacer oligonucleotide
acttaataacgtggtcgattttgttcaggcggga

SEQ ID NO: 576 - DNA, 34 bp, Artificial Sequence
  Description of Artificial Sequence: Synthetic spacer oligonucleotide
acatcagccccttcggaaatagcaatatttcagc

SEQ ID NO: 577 - DNA, 34 bp, Artificial Sequence
  Description of Artificial Sequence: Synthetic spacer oligonucleotide
acgccagcggcgcagggttcgcgtcaatgctgga

SEQ ID NO: 578 - DNA, 34 bp, Artificial Sequence
  Description of Artificial Sequence: Synthetic spacer oligonucleotide
acagctgggaagattgggcgctttcaatatcttc

SEQ ID NO: 579 - DNA, 34 bp, Artificial Sequence
  Description of Artificial Sequence: Synthetic spacer oligonucleotide
actcgctaagggagtcatttttcaggaatgtgat

SEQ ID NO: 580 - DNA, 34 bp, Artificial Sequence
  Description of Artificial Sequence: Synthetic spacer oligonucleotide
acggtttgccgacgggggttatctgatatttgat

SEQ ID NO: 581 - DNA, 35 bp, Artificial Sequence
  Description of Artificial Sequence: Synthetic spacer oligonucleotide
acgcacggacactccggtaaagcgctggtgtacga

SEQ ID NO: 582 - DNA, 34 bp, Artificial Sequence
  Description of Artificial Sequence: Synthetic spacer oligonucleotide
acaccaccctgtccgacagtctggataaatatcg

SEQ ID NO: 583 - DNA, 34 bp, Artificial Sequence
  Description of Artificial Sequence: Synthetic spacer oligonucleotide
actggcacaagttcttaagtgcgatgttgaatgg

SEQ ID NO: 584 - DNA, 34 bp, Artificial Sequence
  Description of Artificial Sequence: Synthetic spacer oligonucleotide
acttcgtcttcatcaaaatccagcaccggtttta

SEQ ID NO: 585 - DNA, 34 bp, Artificial Sequence
  Description of Artificial Sequence: Synthetic spacer oligonucleotide
acccagcgtggcgggattttgccgaacagggcat

SEQ ID NO: 586 - DNA, 34 bp, Artificial Sequence
  Description of Artificial Sequence: Synthetic spacer oligonucleotide
accagcgcctgacgagtgctgaaaatgacctcgt

SEQ ID NO: 587 - DNA, 34 bp, Artificial Sequence
  Description of Artificial Sequence: Synthetic spacer oligonucleotide
acttttcacgtagcgcacgattcggggatatagc

SEQ ID NO: 588 - DNA, 35 bp, Artificial Sequence
  Description of Artificial Sequence: Synthetic spacer oligonucleotide
acacaaaatccttgcattccagacgctgaatttcg

SEQ ID NO: 589 - DNA, 34 bp, Artificial Sequence
  Description of Artificial Sequence: Synthetic spacer oligonucleotide
accaaaaatcgttgcgccagtggaaatggtatgg

SEQ ID NO: 590 - DNA, 32 bp, Artificial Sequence
  Description of Artificial Sequence: Synthetic spacer oligonucleotide
ggcgttcggcggactaaggtaagtgccgctct

SEQ ID NO: 591 - DNA, 32 bp, Artificial Sequence
  Description of Artificial Sequence: Synthetic spacer oligonucleotide
tggtctttgccttgcaggcatatgacgctctt

SEQ ID NO: 592 - DNA, 32 bp, Artificial Sequence
  Description of Artificial Sequence: Synthetic spacer oligonucleotide
ttttacgcacccctcgccaaatgagatcacac

SEQ ID NO: 593 - DNA, 31 bp, Artificial Sequence
  Description of Artificial Sequence: Synthetic spacer oligonucleotide
aaggaagggcgctggagctgcagggatacga

SEQ ID NO: 594 - DNA, 32 bp, Artificial Sequence
  Description of Artificial Sequence: Synthetic spacer oligonucleotide
tgttgagttgtacgcggtggcaactgtagggg

SEQ ID NO: 595 - DNA, 32 bp, Artificial Sequence
  Description of Artificial Sequence: Synthetic spacer oligonucleotide
ccgctccctcccaataaccccatatttgaccc

SEQ ID NO: 596 - DNA, 32 bp, Artificial Sequence
  Description of Artificial Sequence: Synthetic spacer oligonucleotide
ttccctggtgctgagtgatggatattgccgcc

SEQ ID NO: 597 - DNA, 32 bp, Artificial Sequence
  Description of Artificial Sequence: Synthetic spacer oligonucleotide
tccccggagcgaatccgatagtagcgtcctcc

SEQ ID NO: 598 - DNA, 33 bp, Artificial Sequence
  Description of Artificial Sequence: Synthetic spacer oligonucleotide
gatccggtatatcgcggtgatccgagctatgag

SEQ ID NO: 599 - DNA, 32 bp, Artificial Sequence
  Description of Artificial Sequence: Synthetic spacer oligonucleotide
tagcggccaatggaccgccacacgagaaaata

SEQ ID NO: 600 - DNA, 32 bp, Artificial Sequence
  Description of Artificial Sequence: Synthetic spacer oligonucleotide
ttgcgtcagcatatagccaatatggggcaccg

SEQ ID NO: 601 - DNA, 32 bp, Artificial Sequence
  Description of Artificial Sequence: Synthetic spacer oligonucleotide
tgaccagtacgaatgccgtcggcgatttttgt

SEQ ID NO: 602 - DNA, 34 bp, Artificial Sequence
  Description of Artificial Sequence: Synthetic spacer oligonucleotide
acgatggtcctggcatcatcccacgttcccgcgc

SEQ ID NO: 603 - DNA, 34 bp, Artificial Sequence
  Description of Artificial Sequence: Synthetic spacer oligonucleotide
acagaattactggttggcgatacggtggagttaa

SEQ ID NO: 604 - DNA, 34 bp, Artificial Sequence
  Description of Artificial Sequence: Synthetic spacer oligonucleotide
actttaagatctgtatagagaaaagaagcggcag

SEQ ID NO: 605 - DNA, 34 bp, Artificial Sequence
  Description of Artificial Sequence: Synthetic spacer oligonucleotide
acataatgaccgttacgcgcatcttgaaaatcgg

SEQ ID NO: 606 - DNA, 34 bp, Artificial Sequence
  Description of Artificial Sequence: Synthetic spacer oligonucleotide
acccccccaagccccttagcagcccactggagca

SEQ ID NO: 607 - DNA, 34 bp, Artificial Sequence
  Description of Artificial Sequence: Synthetic spacer oligonucleotide
acgacttttcgttgcatcggcgctgaaacactcc

SEQ ID NO: 608 - DNA, 34 bp, Artificial Sequence
  Description of Artificial Sequence: Synthetic spacer oligonucleotide
acccacaaagttactgtaggtactatccagcaca

SEQ ID NO: 609 - DNA, 34 bp, Artificial Sequence
  Description of Artificial Sequence: Synthetic spacer oligonucleotide
acatcagcgttccggcatcatcacagtcagaatt

SEQ ID NO: 610 - DNA, 34 bp, Artificial Sequence
  Description of Artificial Sequence: Synthetic spacer oligonucleotide
acgagcgtcacctgctggcgctcgttagtgagca

SEQ ID NO: 611 - DNA, 34 bp, Artificial Sequence
  Description of Artificial Sequence: Synthetic spacer oligonucleotide
acgttacacacgtaggccatgctgttgatgtcgg

SEQ ID NO: 612 - DNA, 34 bp, Artificial Sequence
  Description of Artificial Sequence: Synthetic spacer oligonucleotide
acttatttaccccgtcgcggccacgtggttttgc

SEQ ID NO: 613 - DNA, 34 bp, Artificial Sequence
  Description of Artificial Sequence: Synthetic spacer oligonucleotide
acttgccacgtatccaggagcaggtcatccaacg

SEQ ID NO: 614 - DNA, 30 bp, Artificial Sequence
  Description of Artificial Sequence: Synthetic spacer oligonucleotide
actttgccgccagcacttcgagctcttttt

SEQ ID NO: 615 - skipped

SEQ ID NO: 616 - DNA, 34 bp, Artificial Sequence
  Description of Artificial Sequence: Synthetic spacer oligonucleotide
acgtgcgaacgccgtgtaaaaaatcggttgaact

SEQ ID NO: 617 - DNA, 34 bp, Artificial Sequence
  Description of Artificial Sequence: Synthetic spacer oligonucleotide
actatgtttgccgctgctcggtgagggagcgttt

SEQ ID NO: 618 - DNA, 34 bp, Artificial Sequence
  Description of Artificial Sequence: Synthetic spacer oligonucleotide
acgttaatccagtattcctgcacgtcatttaaat

SEQ ID NO: 619 - DNA, 34 bp, Artificial Sequence
  Description of Artificial Sequence: Synthetic spacer oligonucleotide
actgtgggccgtaacgtgggatcaggattttggt

SEQ ID NO: 620 - DNA, 34 bp, Artificial Sequence
  Description of Artificial Sequence: Synthetic spacer oligonucleotide
acccacgcaatagttaaaaaagttgctatatcga

SEQ ID NO: 621 - DNA, 34 bp, Artificial Sequence
  Description of Artificial Sequence: Synthetic spacer oligonucleotide
acattgcagatggcgtaattatcaggcgggggag

SEQ ID NO: 622 - DNA, 34 bp, Artificial Sequence
  Description of Artificial Sequence: Synthetic spacer oligonucleotide
actgatactggtaaaatcaccggcgttgcactac

SEQ ID NO: 623 - DNA, 34 bp, Artificial Sequence
  Description of Artificial Sequence: Synthetic spacer oligonucleotide
acctgccgacgaactaccgcgcgggtagcctggt

SEQ ID NO: 624 - DNA, 34 bp, Artificial Sequence
  Description of Artificial Sequence: Synthetic spacer oligonucleotide
acgtggccaccagctcgatcaatcatgagcgatc

SEQ ID NO: 625 - DNA, 34 bp, Artificial Sequence
  Description of Artificial Sequence: Synthetic spacer oligonucleotide
accgtccccggagttctgtccagcaacgacaacg

SEQ ID NO: 626 - DNA, 34 bp, Artificial Sequence
  Description of Artificial Sequence: Synthetic spacer oligonucleotide
acgattgatacctcgacgggctggccgttcttca

SEQ ID NO: 627 - DNA, 34 bp, Artificial Sequence
  Description of Artificial Sequence: Synthetic spacer oligonucleotide
actcccggtgcgcctgttcgtactgcgcgcgagc

SEQ ID NO: 628 - DNA, 34 bp, Artificial Sequence
  Description of Artificial Sequence: Synthetic spacer oligonucleotide
acggaatcatagttatcgataagcaggatcatgg

SEQ ID NO: 629 - DNA, 34 bp, Artificial Sequence
  Description of Artificial Sequence: Synthetic spacer oligonucleotide
accgtcacgaacggcagcacccgctcgcgatagc

SEQ ID NO: 630 - DNA, 34 bp, Artificial Sequence
  Description of Artificial Sequence: Synthetic spacer oligonucleotide
accgccttacccctgcgcattggttgtctgttgg

SEQ ID NO: 631 - DNA, 34 bp, Artificial Sequence
  Description of Artificial Sequence: Synthetic spacer oligonucleotide
acgtagtcaggaccgctgacgcgttcgaaatcgt

SEQ ID NO: 632 - DNA, 34 bp, Artificial Sequence
  Description of Artificial Sequence: Synthetic spacer oligonucleotide
acggaagctgcatgagagccagctacctgatgaa

SEQ ID NO: 633 - DNA, 34 bp, Artificial Sequence
  Description of Artificial Sequence: Synthetic spacer oligonucleotide
accgtctatgcggattggatttgatgagcgtatc

SEQ ID NO: 634 - DNA, 34 bp, Artificial Sequence
  Description of Artificial Sequence: Synthetic spacer oligonucleotide
acaatttaaaacgtgattcatgtctgattttttg

SEQ ID NO: 635 - DNA, 34 bp, Artificial Sequence
  Description of Artificial Sequence: Synthetic spacer oligonucleotide
acgcgcttattcgtcagccaatcgacgaggctat

SEQ ID NO: 636 - DNA, 34 bp, Artificial Sequence
  Description of Artificial Sequence: Synthetic spacer oligonucleotide
accaagcgcatctaactccccctttgcttttttc

SEQ ID NO: 637 - DNA, 34 bp, Artificial Sequence
  Description of Artificial Sequence: Synthetic spacer oligonucleotide
actaaaaaacggtgtcggcacgtcctttatccca

SEQ ID NO: 638 - DNA, 34 bp, Artificial Sequence
  Description of Artificial Sequence: Synthetic spacer oligonucleotide
acgcgcctgttttaaattcatcctcaataatttt

SEQ ID NO: 639 - DNA, 34 bp, Artificial Sequence
  Description of Artificial Sequence: Synthetic spacer oligonucleotide
acgttactgagcgcagcgggttagaggttaagcg

SEQ ID NO: 640 - DNA, 34 bp, Artificial Sequence
  Description of Artificial Sequence: Synthetic spacer oligonucleotide
acgttcagcattgctatctgaatagaggtacaag

SEQ ID NO: 641 - DNA, 34 bp, Artificial Sequence
  Description of Artificial Sequence: Synthetic spacer oligonucleotide
actgcagcatgttttcatcaataccaagttgggc

SEQ ID NO: 642 - DNA, 34 bp, Artificial Sequence
  Description of Artificial Sequence: Synthetic spacer oligonucleotide
actcctcttcagtaccgtatttctgttcccacgt

SEQ ID NO: 643 - DNA, 34 bp, Artificial Sequence
  Description of Artificial Sequence: Synthetic spacer oligonucleotide
actccccgcggcgcttttcgacctcttctgcggc

SEQ ID NO: 644 - DNA, 34 bp, Artificial Sequence
  Description of Artificial Sequence: Synthetic spacer oligonucleotide
acttccctgtgattttgcacgccatgtaatcagg

SEQ ID NO: 645 - DNA, 34 bp, Artificial Sequence
  Description of Artificial Sequence: Synthetic spacer oligonucleotide
acgtaacgtctttaacgttcgtcaggtggttaat

SEQ ID NO: 646 - DNA, 34 bp, Artificial Sequence
  Description of Artificial Sequence: Synthetic spacer oligonucleotide
acatggcggccggcatggtttgctgagattgagc

SEQ ID NO: 647 - DNA, 34 bp, Artificial Sequence
  Description of Artificial Sequence: Synthetic spacer oligonucleotide
accgttttagggtcgtgaatctttccgtcacgca

SEQ ID NO: 648 - DNA, 34 bp, Artificial Sequence
  Description of Artificial Sequence: Synthetic spacer oligonucleotide
actaatgtttgtcttgatgagttgtcagtgtatt

SEQ ID NO: 649 - DNA, 34 bp, Artificial Sequence
  Description of Artificial Sequence: Synthetic spacer oligonucleotide
acgtaattttttataatcagccaaggatcaacct

SEQ ID NO: 650 - DNA, 34 bp, Artificial Sequence
  Description of Artificial Sequence: Synthetic spacer oligonucleotide
acgtagcgtctatcattttcagcacaagttgggt

SEQ ID NO: 651 - DNA, 34 bp, Artificial Sequence
  Description of Artificial Sequence: Synthetic spacer oligonucleotide
accatggtcggatcgcctggatgcagcaattcag

SEQ ID NO: 652 - DNA, 34 bp, Artificial Sequence
  Description of Artificial Sequence: Synthetic spacer oligonucleotide
acgtggtgtgcttcaattttactggcatcgaatg

SEQ ID NO: 653 - DNA, 34 bp, Artificial Sequence
  Description of Artificial Sequence: Synthetic spacer oligonucleotide
acgccattcggcattcgtgcgaatttttcatccg

SEQ ID NO: 654 - DNA, 34 bp, Artificial Sequence
  Description of Artificial Sequence: Synthetic spacer oligonucleotide
acacaggcaagatgaaccacacccagcgaccata

SEQ ID NO: 655 - DNA, 34 bp, Artificial Sequence
  Description of Artificial Sequence: Synthetic spacer oligonucleotide
actgttttgagagaggaccacgcggctacgctcg

SEQ ID NO: 656 - DNA, 34 bp, Artificial Sequence
  Description of Artificial Sequence: Synthetic spacer oligonucleotide
actagaacgtgtcgcagccgccagcggccgcaga

SEQ ID NO: 657 - DNA, 34 bp, Artificial Sequence
  Description of Artificial Sequence: Synthetic spacer oligonucleotide
atgtacgaaatgtccagacaatcgaaatacgcaa

SEQ ID NO: 658 - DNA, 34 bp, Artificial Sequence
  Description of Artificial Sequence: Synthetic spacer oligonucleotide
acttccctgcgcagttttagcatcatcggtatcc

SEQ ID NO: 659 - DNA, 34 bp, Artificial Sequence
  Description of Artificial Sequence: Synthetic spacer oligonucleotide
accttcaccgggcgccgcgtctgcgtcttcctgc

SEQ ID NO: 660 - DNA, 34 bp, Artificial Sequence
  Description of Artificial Sequence: Synthetic spacer oligonucleotide
acgtttcttttgccagtagttctctgtaagtagc

SEQ ID NO: 661 - DNA, 35 bp, Artificial Sequence
  Description of Artificial Sequence: Synthetic spacer oligonucleotide
acctgaacacaaatcaaaatataatcgttctgaac

SEQ ID NO: 662 - DNA, 34 bp, Artificial Sequence
  Description of Artificial Sequence: Synthetic spacer oligonucleotide
acctacggtaaattctggtctgtcaacggttgta

SEQ ID NO: 663 - DNA, 34 bp, Artificial Sequence
  Description of Artificial Sequence: Synthetic spacer oligonucleotide
acccggtaaatggttgtggtggctgatccagcat

SEQ ID NO: 664 - DNA, 34 bp, Artificial Sequence
  Description of Artificial Sequence: Synthetic spacer oligonucleotide
acatacgaggtaaataactctctgctgtttttac

SEQ ID NO: 665 - DNA, 34 bp, Artificial Sequence
  Description of Artificial Sequence: Synthetic spacer oligonucleotide
acgcactcaaagttaagcgctccgagtctgatat

SEQ ID NO: 666 - DNA, 34 bp, Artificial Sequence
  Description of Artificial Sequence: Synthetic spacer oligonucleotide
acatacgccagattcagaaaaggccgctatctgg

SEQ ID NO: 667 - DNA, 34 bp, Artificial Sequence
  Description of Artificial Sequence: Synthetic spacer oligonucleotide
acatacgccagattcagaaaagaccgctatctgg

SEQ ID NO: 668 - DNA, 43 bp, Artificial Sequence
  Description of Artificial Sequence: Synthetic spacer oligonucleotide
acttcggcaacggctgcggcgacggcgacggtagcggcgacgg

SEQ ID NO: 669 - DNA, 34 bp, Artificial Sequence
  Description of Artificial Sequence: Synthetic spacer oligonucleotide
actgtggcggtggtgggctgcggaatctatcagc

SEQ ID NO: 670 - DNA, 34 bp, Artificial Sequence
  Description of Artificial Sequence: Synthetic spacer oligonucleotide
acgataagtttcgccatcagaaccgccctccaac

SEQ ID NO: 671 - DNA, 34 bp, Artificial Sequence
  Description of Artificial Sequence: Synthetic spacer oligonucleotide
acagacacaaaaacaccagcaaaggacgttaccc

SEQ ID NO: 672 - DNA, 34 bp, Artificial Sequence
  Description of Artificial Sequence: Synthetic spacer oligonucleotide
accaatgatgagctataacgaattacagattcat

SEQ ID NO: 673 - DNA, 34 bp, Artificial Sequence
  Description of Artificial Sequence: Synthetic spacer oligonucleotide
acccaaaatcaggagtcgagagctccaggctctg

SEQ ID NO: 674 - DNA, 34 bp, Artificial Sequence
  Description of Artificial Sequence: Synthetic spacer oligonucleotide
acgttaatgaatcaaatccagtccagtcgtattg

SEQ ID NO: 675 - DNA, 34 bp, Artificial Sequence
  Description of Artificial Sequence: Synthetic spacer oligonucleotide
acggcgaccaaaattatcacgccagcgttactgg

SEQ ID NO: 676 - DNA, 34 bp, Artificial Sequence
  Description of Artificial Sequence: Synthetic spacer oligonucleotide
acagaagccactgtctggggtggctatgccattt

SEQ ID NO: 677 - DNA, 34 bp, Artificial Sequence
  Description of Artificial Sequence: Synthetic spacer oligonucleotide
actttgtttttactaattcgtttcatcattcccc

SEQ ID NO: 678 - DNA, 34 bp, Artificial Sequence
  Description of Artificial Sequence: Synthetic spacer oligonucleotide
acatgccgaccctgactgcaatcatggtcagcgc

SEQ ID NO: 679 - DNA, 34 bp, Artificial Sequence
  Description of Artificial Sequence: Synthetic spacer oligonucleotide
acagtaacgagcgccactctcagagcgataaacg

SEQ ID NO: 680 - DNA, 34 bp, Artificial Sequence
  Description of Artificial Sequence: Synthetic spacer oligonucleotide
accagtgcggccagaatcccgatcaacatattcg

SEQ ID NO: 681 - DNA, 34 bp, Artificial Sequence
  Description of Artificial Sequence: Synthetic spacer oligonucleotide
actactgctatcaacctcgccacctcgaccgcac

SEQ ID NO: 682 - DNA, 34 bp, Artificial Sequence
  Description of Artificial Sequence: Synthetic spacer oligonucleotide
acggactgtctgtgcagcgcgtccagcgcctgcg

SEQ ID NO: 683 - DNA, 34 bp, Artificial Sequence
  Description of Artificial Sequence: Synthetic spacer oligonucleotide
accgggaggcggaatgcagcaaaaataaaaaccg

SEQ ID NO: 684 - DNA, 34 bp, Artificial Sequence
  Description of Artificial Sequence: Synthetic spacer oligonucleotide
acacgttaaaaagtcctgtcggcggtacagtgga

SEQ ID NO: 685 - DNA, 34 bp, Artificial Sequence
  Description of Artificial Sequence: Synthetic spacer oligonucleotide
actttacttcaccgtcctgaagcattttaacagt

SEQ ID NO: 686 - DNA, 34 bp, Artificial Sequence
  Description of Artificial Sequence: Synthetic spacer oligonucleotide
acggcggcagtcgtcgtaccagataccaatctgc

SEQ ID NO: 687 - DNA, 35 bp, Artificial Sequence
  Description of Artificial Sequence: Synthetic spacer oligonucleotide
acgctgaaaggcgaacacctgatgacctttgatac

SEQ ID NO: 688 - DNA, 34 bp, Artificial Sequence
  Description of Artificial Sequence: Synthetic spacer oligonucleotide
acttatttctatgggcggacgaaaaagcattaag

SEQ ID NO: 689 - DNA, 34 bp, Artificial Sequence
  Description of Artificial Sequence: Synthetic spacer oligonucleotide
acacggttaatgttaatgtcgtaaataacgaagg

SEQ ID NO: 690 - DNA, 34 bp, Artificial Sequence
  Description of Artificial Sequence: Synthetic spacer oligonucleotide
acatcagcccgccagcggttcatgttgtaatgtt

SEQ ID NO: 691 - DNA, 34 bp, Artificial Sequence
  Description of Artificial Sequence: Synthetic spacer oligonucleotide
acattgtctttagctaaagaggcgagagttatac

SEQ ID NO: 692 - DNA, 34 bp, Artificial Sequence
  Description of Artificial Sequence: Synthetic spacer oligonucleotide
accccgcgttgttccggttgttcccggatcggtc

SEQ ID NO: 693 - DNA, 34 bp, Artificial Sequence
  Description of Artificial Sequence: Synthetic spacer oligonucleotide
acatatccccaaaattattgaattaggcagggag

SEQ ID NO: 694 - DNA, 34 bp, Artificial Sequence
  Description of Artificial Sequence: Synthetic spacer oligonucleotide
acgctttatttgttcctgccgtatacgctgcgga

SEQ ID NO: 695 - DNA, 34 bp, Artificial Sequence
  Description of Artificial Sequence: Synthetic spacer oligonucleotide
acaacacctaaggagattagttatgaaaatgatt

SEQ ID NO: 696 - DNA, 34 bp, Artificial Sequence
  Description of Artificial Sequence: Synthetic spacer oligonucleotide
acttattttcgtaaaagattaacggaggtcgccc

SEQ ID NO: 697 - DNA, 34 bp, Artificial Sequence
  Description of Artificial Sequence: Synthetic spacer oligonucleotide
accctattattaacgaaatattaatcacctcttt

SEQ ID NO: 698 - DNA, 34 bp, Artificial Sequence
  Description of Artificial Sequence: Synthetic spacer oligonucleotide
acaaccgcccgggcatctttggaagtcattgact

SEQ ID NO: 699 - DNA, 34 bp, Artificial Sequence
  Description of Artificial Sequence: Synthetic spacer oligonucleotide
acccctgcgcgaatccagccgtccagatgtttcg

SEQ ID NO: 700 - DNA, 34 bp, Artificial Sequence
  Description of Artificial Sequence: Synthetic spacer oligonucleotide
acttctcgggagaacggtaagcgtattgcctgaa

SEQ ID NO: 701 - DNA, 34 bp, Artificial Sequence
  Description of Artificial Sequence: Synthetic spacer oligonucleotide
acataagctgataaacgttgcgctcctgctcact

SEQ ID NO: 702 - DNA, 65 bp, Artificial Sequence
  Description of Artificial Sequence: Synthetic spacer oligonucleotide
actcgcgtggctgtttttgggcgcggggaacactgcagcgcggccacaccagtggagccgctacc

SEQ ID NO: 703 - DNA, 34 bp, Artificial Sequence
  Description of Artificial Sequence: Synthetic spacer oligonucleotide
actccacccataccgcccatatctgtaaggccgt

SEQ ID NO: 704 - DNA, 34 bp, Artificial Sequence
  Description of Artificial Sequence: Synthetic spacer oligonucleotide
acaagtagcgggaaagttgagggcagtggttatc

SEQ ID NO: 705 - DNA, 34 bp, Artificial Sequence
  Description of Artificial Sequence: Synthetic spacer oligonucleotide
acgccaccgacagtccccatcgctgagttaactg

SEQ ID NO: 706 - DNA, 34 bp, Artificial Sequence
  Description of Artificial Sequence: Synthetic spacer oligonucleotide
actccaacgggggggacgctgacaattaggctga

SEQ ID NO: 707 - DNA, 34 bp, Artificial Sequence
  Description of Artificial Sequence: Synthetic spacer oligonucleotide
acccggcggtcgacatcgagcaggaatttcgaaa

SEQ ID NO: 708 - DNA, 34 bp, Artificial Sequence
  Description of Artificial Sequence: Synthetic spacer oligonucleotide
actatctaaccaatttccagcctgatcagtccag

SEQ ID NO: 709 - DNA, 34 bp, Artificial Sequence
  Description of Artificial Sequence: Synthetic spacer oligonucleotide
accacaatcagatcggcaaaattaccgaaaatca

SEQ ID NO: 710 - DNA, 34 bp, Artificial Sequence
  Description of Artificial Sequence: Synthetic spacer oligonucleotide
actcactgtatgagggcattttagatttagcgat

SEQ ID NO: 711 - DNA, 34 bp, Artificial Sequence
  Description of Artificial Sequence: Synthetic spacer oligonucleotide
accacggccccgagggaagcaaaattttaacggc

SEQ ID NO: 712 - DNA, 34 bp, Artificial Sequence
  Description of Artificial Sequence: Synthetic spacer oligonucleotide
acagcagtaggatcgctctctctacctctccagc

SEQ ID NO: 713 - DNA, 34 bp, Artificial Sequence
  Description of Artificial Sequence: Synthetic spacer oligonucleotide
acgtatgactcgcgaataatcggaaaccagccac

SEQ ID NO: 714 - DNA, 34 bp, Artificial Sequence
  Description of Artificial Sequence: Synthetic spacer oligonucleotide
actttttagaggtgtacacactgtcggccttttg

SEQ ID NO: 715 - DNA, 34 bp, Artificial Sequence
  Description of Artificial Sequence: Synthetic spacer oligonucleotide
accaccttagcgacgaaattaaaaccgagctcac

SEQ ID NO: 716 - DNA, 34 bp, Artificial Sequence
  Description of Artificial Sequence: Synthetic spacer oligonucleotide
acgctttgccccatgcgtccagatcttcaacggg

SEQ ID NO: 717 - DNA, 34 bp, Artificial Sequence
  Description of Artificial Sequence: Synthetic spacer oligonucleotide
acaactgcagattatgctaaatcgccgcgggcgc

SEQ ID NO: 718 - DNA, 34 bp, Artificial Sequence
  Description of Artificial Sequence: Synthetic spacer oligonucleotide
acgcggccggagtcagaccgaattcaaccaggta

SEQ ID NO: 719 - DNA, 34 bp, Artificial Sequence
  Description of Artificial Sequence: Synthetic spacer oligonucleotide
acgcgtacttcctgccttcctgtaattcagcata

SEQ ID NO: 720 - DNA, 34 bp, Artificial Sequence
  Description of Artificial Sequence: Synthetic spacer oligonucleotide
acaaacatcatcccgtcctgagtaattgatgtct

SEQ ID NO: 721 - DNA, 34 bp, Artificial Sequence
  Description of Artificial Sequence: Synthetic spacer oligonucleotide
acgcatttttggtgcggacataaacgtaatacgt

SEQ ID NO: 722 - DNA, 34 bp, Artificial Sequence
  Description of Artificial Sequence: Synthetic spacer oligonucleotide
acctacttatgccaacatggcctttcgtttgcca

SEQ ID NO: 723 - DNA, 34 bp, Artificial Sequence
  Description of Artificial Sequence: Synthetic spacer oligonucleotide
acttaaaacgagtaaaattccatccgtttttatt

SEQ ID NO: 724 - DNA, 35 bp, Artificial Sequence
  Description of Artificial Sequence: Synthetic spacer oligonucleotide
acaagtatcgacaatttttgacatgcgagccgcgc

SEQ ID NO: 725 - DNA, 34 bp, Artificial Sequence
  Description of Artificial Sequence: Synthetic spacer oligonucleotide
acaggattggggcgaccggttaactgtaacgcgt

SEQ ID NO: 726 - DNA, 34 bp, Artificial Sequence
  Description of Artificial Sequence: Synthetic spacer oligonucleotide
acccgtatgcaccatgcgctcgttgtctttgtcc

SEQ ID NO: 727 - DNA, 34 bp, Artificial Sequence
  Description of Artificial Sequence: Synthetic spacer oligonucleotide
actatatctgcgtcagtgccaccgtcaacacaca

SEQ ID NO: 728 - DNA, 34 bp, Artificial Sequence
  Description of Artificial Sequence: Synthetic spacer oligonucleotide
actatgacctgaaatagctcccccggatctccgc

SEQ ID NO: 729 - DNA, 34 bp, Artificial Sequence
  Description of Artificial Sequence: Synthetic spacer oligonucleotide
acgggctggccggttgcccgggatttggaggccg

SEQ ID NO: 730 - DNA, 34 bp, Artificial Sequence
  Description of Artificial Sequence: Synthetic spacer oligonucleotide
acataacctcttgcgtgccgtaatgctggtgttt

SEQ ID NO: 731 - DNA, 34 bp, Artificial Sequence
  Description of Artificial Sequence: Synthetic spacer oligonucleotide
acataacctcttgcgtgccgtaatgttggtgttt

SEQ ID NO: 732 - DNA, 34 bp, Artificial Sequence
  Description of Artificial Sequence: Synthetic spacer oligonucleotide
acgcgcctgcgcgaacagcaggaggcgtaatgag

SEQ ID NO: 733 - DNA, 34 bp, Artificial Sequence
  Description of Artificial Sequence: Synthetic spacer oligonucleotide
attttttagaggtgtacacaccgtcggccttttg

SEQ ID NO: 734 - DNA, 34 bp, Artificial Sequence
  Description of Artificial Sequence: Synthetic spacer oligonucleotide
acttggttttttaatactttctggttgcactgtt

SEQ ID NO: 735 - DNA, 34 bp, Artificial Sequence
  Description of Artificial Sequence: Synthetic spacer oligonucleotide
acatcacgcaagcccatccccacggagcctcgtc

SEQ ID NO: 736 - DNA, 34 bp, Artificial Sequence
  Description of Artificial Sequence: Synthetic spacer oligonucleotide
acttcctgaattcttcagatcaactaaataattc

SEQ ID NO: 737 - DNA, 34 bp, Artificial Sequence
  Description of Artificial Sequence: Synthetic spacer oligonucleotide
actgccattgccagttcgccgttgcagtgctcgt

SEQ ID NO: 738 - DNA, 34 bp, Artificial Sequence
  Description of Artificial Sequence: Synthetic spacer oligonucleotide
actgtataaagccgttctcaacgtcctgtggaac

SEQ ID NO: 739 - DNA, 34 bp, Artificial Sequence
  Description of Artificial Sequence: Synthetic spacer oligonucleotide
acctgttcgccaggctttccgctcacaccgcgac

SEQ ID NO: 740 - DNA, 34 bp, Artificial Sequence
  Description of Artificial Sequence: Synthetic spacer oligonucleotide
actagcgcaaattttgcgaattatgcactgtttg

SEQ ID NO: 741 - DNA, 34 bp, Artificial Sequence
  Description of Artificial Sequence: Synthetic spacer oligonucleotide
actttggtgtccgacacataacggagagataaac

SEQ ID NO: 742 - DNA, 34 bp, Artificial Sequence
  Description of Artificial Sequence: Synthetic spacer oligonucleotide
acatttcccccaacatccattgggcgctacctac

SEQ ID NO: 743 - DNA, 34 bp, Artificial Sequence
  Description of Artificial Sequence: Synthetic spacer oligonucleotide
accccggataacctttccctccctgacgagctcg

SEQ ID NO: 744 - DNA, 34 bp, Artificial Sequence
  Description of Artificial Sequence: Synthetic spacer oligonucleotide
acgcaatgccaggttccaggaaatcgcctggaca

SEQ ID NO: 745 - DNA, 34 bp, Artificial Sequence
  Description of Artificial Sequence: Synthetic spacer oligonucleotide
acgtaaattgacgagaacgcccgcagattgcggg

SEQ ID NO: 746 - DNA, 34 bp, Artificial Sequence
  Description of Artificial Sequence: Synthetic spacer oligonucleotide
acttaccccggacaggtacgtgaatatatcgaca

SEQ ID NO: 747 - DNA, 34 bp, Artificial Sequence
  Description of Artificial Sequence: Synthetic spacer oligonucleotide
acacgctgagactattaaagattttctcgtctcc

SEQ ID NO: 748 - DNA, 34 bp, Artificial Sequence
  Description of Artificial Sequence: Synthetic spacer oligonucleotide
actcgctgaattaacggcgctgttaatgattgcc

SEQ ID NO: 749 - DNA, 34 bp, Artificial Sequence
  Description of Artificial Sequence: Synthetic spacer oligonucleotide
acacgcaactcggcgcaaacctcgattgcgagcg

SEQ ID NO: 750 - DNA, 32 bp, Artificial Sequence
  Description of Artificial Sequence: Synthetic spacer oligonucleotide
ttgatccagtgcgtcagcggcttaatgcgggc

SEQ ID NO: 751 - DNA, 34 bp, Artificial Sequence
  Description of Artificial Sequence: Synthetic spacer oligonucleotide
acttttaaataaatcggctattatctggagaccg

SEQ ID NO: 752 - DNA, 34 bp, Artificial Sequence
  Description of Artificial Sequence: Synthetic spacer oligonucleotide
acatgttgtcgcgcgtgatggtgatgtgattatt

SEQ ID NO: 753 - DNA, 34 bp, Artificial Sequence
  Description of Artificial Sequence: Synthetic spacer oligonucleotide
actttagtagtcgccttgccgtcataattagatt

SEQ ID NO: 754 - DNA, 34 bp, Artificial Sequence
  Description of Artificial Sequence: Synthetic spacer oligonucleotide
acttgcccttcagccttcattttcccggctgttg

SEQ ID NO: 755 - DNA, 34 bp, Artificial Sequence
  Description of Artificial Sequence: Synthetic spacer oligonucleotide
actgtcgcaggaggaatgggaagcgttgcctgcg

SEQ ID NO: 756 - DNA, 34 bp, Artificial Sequence
  Description of Artificial Sequence: Synthetic spacer oligonucleotide
acaagaggaaaaggaatttcgccactgtatatgg

SEQ ID NO: 757 - DNA, 34 bp, Artificial Sequence
  Description of Artificial Sequence: Synthetic spacer oligonucleotide
acgcgatattgcggctagcctcgtctactcgcgc

SEQ ID NO: 758 - DNA, 34 bp, Artificial Sequence
  Description of Artificial Sequence: Synthetic spacer oligonucleotide
actatcagcaggcatggtttctcgaccgcgcccg

SEQ ID NO: 759 - DNA, 34 bp, Artificial Sequence
  Description of Artificial Sequence: Synthetic spacer oligonucleotide
acgaacgcgcctggctccaggtaggttgggaagc

SEQ ID NO: 760 - DNA, 34 bp, Artificial Sequence
  Description of Artificial Sequence: Synthetic spacer oligonucleotide
acggctccggcaatcccgctcccaatgcatccga

SEQ ID NO: 761 - DNA, 34 bp, Artificial Sequence
  Description of Artificial Sequence: Synthetic spacer oligonucleotide
acccgttttcatcagacgatgaagaaaccccctc

SEQ ID NO: 762 - DNA, 34 bp, Artificial Sequence
  Description of Artificial Sequence: Synthetic spacer oligonucleotide
acagtatcgacaatttttgacatgcgagccgcgc

SEQ ID NO: 763 - DNA, 34 bp, Artificial Sequence
  Description of Artificial Sequence: Synthetic spacer oligonucleotide
accaacgtatcgttgggaatttcaaacacggcac

SEQ ID NO: 764 - DNA, 34 bp, Artificial Sequence
  Description of Artificial Sequence: Synthetic spacer oligonucleotide
accaccggataacctccgggttctcagctgccac

SEQ ID NO: 765 - DNA, 34 bp, Artificial Sequence
  Description of Artificial Sequence: Synthetic spacer oligonucleotide
acctggctaagctgacaaccatcattaaccaggg

SEQ ID NO: 766 - DNA, 34 bp, Artificial Sequence
  Description of Artificial Sequence: Synthetic spacer oligonucleotide
acgatgcggaaagcgcaccgctcgccagattccc

SEQ ID NO: 767 - DNA, 34 bp, Artificial Sequence
  Description of Artificial Sequence: Synthetic spacer oligonucleotide
acgttcgtatacgattcagaaaaatggggggtcg

SEQ ID NO: 768 - DNA, 34 bp, Artificial Sequence
  Description of Artificial Sequence: Synthetic spacer oligonucleotide
actttctgctcccgtgcggatgcgtccgttgcgt

SEQ ID NO: 769 - DNA, 34 bp, Artificial Sequence
  Description of Artificial Sequence: Synthetic spacer oligonucleotide
actgttgctgctgcgcagcctgggcctgttccat

SEQ ID NO: 770 - DNA, 34 bp, Artificial Sequence
  Description of Artificial Sequence: Synthetic spacer oligonucleotide
acttgcaaccgcatgaactgtatctgtgtcaggg

SEQ ID NO: 771 - DNA, 34 bp, Artificial Sequence
  Description of Artificial Sequence: Synthetic spacer oligonucleotide
accatgttctcgtcgagaagctgttgaatgagtt

SEQ ID NO: 772 - DNA, 34 bp, Artificial Sequence
  Description of Artificial Sequence: Synthetic spacer oligonucleotide
acttaccgacactaataacgccgttgtatagtgc

SEQ ID NO: 773 - DNA, 34 bp, Artificial Sequence
  Description of Artificial Sequence: Synthetic spacer oligonucleotide
acactaagaagtgtaccaattataacttgaaagc

SEQ ID NO: 774 - DNA, 33 bp, Artificial Sequence
  Description of Artificial Sequence: Synthetic spacer oligonucleotide
acggatctaaccccaagagagaacccaaacggg

SEQ ID NO: 775 - DNA, 34 bp, Artificial Sequence
  Description of Artificial Sequence: Synthetic spacer oligonucleotide
accgctatgcacaaatgacgcgccaaaccctaag

SEQ ID NO: 776 - DNA, 34 bp, Artificial Sequence
  Description of Artificial Sequence: Synthetic spacer oligonucleotide
acgtaccacgcgaacggcggcggggatctgcttc

SEQ ID NO: 777 - DNA, 34 bp, Artificial Sequence
  Description of Artificial Sequence: Synthetic spacer oligonucleotide
acacttgaatcaggctatatgcgcgttttagcgt

SEQ ID NO: 778 - DNA, 34 bp, Artificial Sequence
  Description of Artificial Sequence: Synthetic spacer oligonucleotide
acatcgatgacgaggataaaacccggcagcaata

SEQ ID NO: 779 - DNA, 34 bp, Artificial Sequence
  Description of Artificial Sequence: Synthetic spacer oligonucleotide
actttttaaaaggattacagaatgaaaaatttag

SEQ ID NO: 780 - DNA, 34 bp, Artificial Sequence
  Description of Artificial Sequence: Synthetic spacer oligonucleotide
acaaattgcagtaaatattttccatgagtgattc

SEQ ID NO: 781 - DNA, 34 bp, Artificial Sequence
  Description of Artificial Sequence: Synthetic spacer oligonucleotide
accccttcgtaaaccacttaacagtatcgctttg

SEQ ID NO: 782 - DNA, 34 bp, Artificial Sequence
  Description of Artificial Sequence: Synthetic spacer oligonucleotide
acgcgcacgacacctggtcgcctaattctgccga

SEQ ID NO: 783 - DNA, 34 bp, Artificial Sequence
  Description of Artificial Sequence: Synthetic spacer oligonucleotide
acccagcctcccgttacgcatatttgagggtttt

SEQ ID NO: 784 - DNA, 34 bp, Artificial Sequence
  Description of Artificial Sequence: Synthetic spacer oligonucleotide
acgcgatacgtcagtctgacgtgccagaactcga

SEQ ID NO: 785 - DNA, 34 bp, Artificial Sequence
  Description of Artificial Sequence: Synthetic spacer oligonucleotide
acgcggcgctgattatgatttcccgataatttat

SEQ ID NO: 786 - DNA, 34 bp, Artificial Sequence
  Description of Artificial Sequence: Synthetic spacer oligonucleotide
acgcaaacgcgacggaactaaaacctgccgaact

SEQ ID NO: 787 - DNA, 34 bp, Artificial Sequence
  Description of Artificial Sequence: Synthetic spacer oligonucleotide
acgtttcagcgctcacgttccagatcggctcata

SEQ ID NO: 788 - DNA, 34 bp, Artificial Sequence
  Description of Artificial Sequence: Synthetic spacer oligonucleotide
acggtgaatacgtggttatttatactgatactaa

SEQ ID NO: 789 - DNA, 34 bp, Artificial Sequence
  Description of Artificial Sequence: Synthetic spacer oligonucleotide
accaaaagaattagccaggagtaccttccctaac

SEQ ID NO: 790 - DNA, 34 bp, Artificial Sequence
  Description of Artificial Sequence: Synthetic spacer oligonucleotide
actcatagcgcccaggataaacattaaattcata

SEQ ID NO: 791 - DNA, 34 bp, Artificial Sequence
  Description of Artificial Sequence: Synthetic spacer oligonucleotide
acatgaacagggtccaccgcatgactcctccagt

SEQ ID NO: 792 - DNA, 34 bp, Artificial Sequence
  Description of Artificial Sequence: Synthetic spacer oligonucleotide
acttcagaaatttaagagtgacttcgttcaccct

SEQ ID NO: 793 - DNA, 34 bp, Artificial Sequence
  Description of Artificial Sequence: Synthetic spacer oligonucleotide
acgaatttgtcgcctgtgtggtctgcaaacagca

SEQ ID NO: 794 - DNA, 34 bp, Artificial Sequence
  Description of Artificial Sequence: Synthetic spacer oligonucleotide
acctcatcgtcaggccacgcttgcgcacggctgc

SEQ ID NO: 795 - DNA, 34 bp, Artificial Sequence
  Description of Artificial Sequence: Synthetic spacer oligonucleotide
acaacaacaaactgaatgctgtcgagcaggtcgc

SEQ ID NO: 796 - DNA, 34 bp, Artificial Sequence
  Description of Artificial Sequence: Synthetic spacer oligonucleotide
actctgtagtcacgacgtaccacaatttacggcg

SEQ ID NO: 797 - DNA, 34 bp, Artificial Sequence
  Description of Artificial Sequence: Synthetic spacer oligonucleotide
actcatcagtaagccgatcacgttccagcttgtc

SEQ ID NO: 798 - DNA, 34 bp, Artificial Sequence
  Description of Artificial Sequence: Synthetic spacer oligonucleotide
acgccgacatcagcagacgaaaaacctgtggtca

SEQ ID NO: 799 - DNA, 34 bp, Artificial Sequence
  Description of Artificial Sequence: Synthetic spacer oligonucleotide
actcaccggctgaactgaacaagatcaatgccga

SEQ ID NO: 800 - DNA, 34 bp, Artificial Sequence
  Description of Artificial Sequence: Synthetic spacer oligonucleotide
accgcctggcggattgcatcagcgcggtcttcaa

SEQ ID NO: 801 - DNA, 34 bp, Artificial Sequence
  Description of Artificial Sequence: Synthetic spacer oligonucleotide
acattaaaatgcctgtccgcctggctcatttgcg

SEQ ID NO: 802 - DNA, 34 bp, Artificial Sequence
  Description of Artificial Sequence: Synthetic spacer oligonucleotide
acagaactatcgggtaaacagatacgataaagcg

SEQ ID NO: 803 - DNA, 34 bp, Artificial Sequence
  Description of Artificial Sequence: Synthetic spacer oligonucleotide
acagcgacgacgccgtcatcaccggtgactgtga

SEQ ID NO: 804 - DNA, 34 bp, Artificial Sequence
  Description of Artificial Sequence: Synthetic spacer oligonucleotide
acatattcaggcatttaaaactgcgcaattattt

SEQ ID NO: 805 - DNA, 34 bp, Artificial Sequence
  Description of Artificial Sequence: Synthetic spacer oligonucleotide
acatatcttcaataaggttgagttgatactcact

SEQ ID NO: 806 - DNA, 34 bp, Artificial Sequence
  Description of Artificial Sequence: Synthetic spacer oligonucleotide
acgttaccagaaccaagcacgctgttacctgtcc

SEQ ID NO: 807 - DNA, 34 bp, Artificial Sequence
  Description of Artificial Sequence: Synthetic spacer oligonucleotide
acaacgcgtgcgttgccaccccctcacggatcat

SEQ ID NO: 808 - DNA, 34 bp, Artificial Sequence
  Description of Artificial Sequence: Synthetic spacer oligonucleotide
acttcatttttaccgggtggatttcataaatcgt

SEQ ID NO: 809 - DNA, 34 bp, Artificial Sequence
  Description of Artificial Sequence: Synthetic spacer oligonucleotide
acgagatgaagaaaagtcagttcgtcagcgacgg

SEQ ID NO: 810 - DNA, 34 bp, Artificial Sequence
  Description of Artificial Sequence: Synthetic spacer oligonucleotide
acattgcgctggctacctacggcgaattattcag

SEQ ID NO: 811 - DNA, 34 bp, Artificial Sequence
  Description of Artificial Sequence: Synthetic spacer oligonucleotide
actccgaaccttcccggcggatgcccgttttgtg

SEQ ID NO: 812 - DNA, 34 bp, Artificial Sequence
  Description of Artificial Sequence: Synthetic spacer oligonucleotide
acgatgatctggaggccctccctcggcgatggca

SEQ ID NO: 813 - DNA, 34 bp, Artificial Sequence
  Description of Artificial Sequence: Synthetic spacer oligonucleotide
acagatcagtggaaaatcttttatttctaatttg

SEQ ID NO: 814 - DNA, 34 bp, Artificial Sequence
  Description of Artificial Sequence: Synthetic spacer oligonucleotide
acgctatggaggcatggaacgcctgccgcaccgc

SEQ ID NO: 815 - DNA, 34 bp, Artificial Sequence
  Description of Artificial Sequence: Synthetic spacer oligonucleotide
acttggggatatcccccagttgagctactcggat

SEQ ID NO: 816 - DNA, 34 bp, Artificial Sequence
  Description of Artificial Sequence: Synthetic spacer oligonucleotide
acgatatcagccgagaaacgctcaattgcggaca

SEQ ID NO: 817 - DNA, 34 bp, Artificial Sequence
  Description of Artificial Sequence: Synthetic spacer oligonucleotide
acattaccaacgtcagatgacgcgaaacctgaac

SEQ ID NO: 818 - DNA, 34 bp, Artificial Sequence
  Description of Artificial Sequence: Synthetic spacer oligonucleotide
actcgtcaatccacgcgaatatgatcgcctgacc

SEQ ID NO: 819 - DNA, 34 bp, Artificial Sequence
  Description of Artificial Sequence: Synthetic spacer oligonucleotide
actttagaattaaacaaaacatactttatatttt

SEQ ID NO: 820 - DNA, 35 bp, Artificial Sequence
  Description of Artificial Sequence: Synthetic spacer oligonucleotide
acggcagcgcaggccgctttatttagcaattcagc

SEQ ID NO: 821 - DNA, 34 bp, Artificial Sequence
  Description of Artificial Sequence: Synthetic spacer oligonucleotide
acgacactcccagatattcacgctgggggatctc

SEQ ID NO: 822 - DNA, 34 bp, Artificial Sequence
  Description of Artificial Sequence: Synthetic spacer oligonucleotide
accggtagttcgccgacagattgcggacagtggt

SEQ ID NO: 823 - DNA, 34 bp, Artificial Sequence
  Description of Artificial Sequence: Synthetic spacer oligonucleotide
acgtgaagacacggagaaagtctgtgattactgg

SEQ ID NO: 824 - DNA, 35 bp, Artificial Sequence
  Description of Artificial Sequence: Synthetic spacer oligonucleotide
acgtgaggaaacgggcgcgttgctacaacgacgcg

SEQ ID NO: 825 - DNA, 34 bp, Artificial Sequence
  Description of Artificial Sequence: Synthetic spacer oligonucleotide
acgcgacgtattcgcaacggtacggtgcccaatg

SEQ ID NO: 826 - DNA, 34 bp, Artificial Sequence
  Description of Artificial Sequence: Synthetic spacer oligonucleotide
acaaataacctctgacattgtggggaaaggtgaa

SEQ ID NO: 827 - DNA, 34 bp, Artificial Sequence
  Description of Artificial Sequence: Synthetic spacer oligonucleotide
actggttctacctgtatttgagtggaaacccccg

SEQ ID NO: 828 - DNA, 34 bp, Artificial Sequence
  Description of Artificial Sequence: Synthetic spacer oligonucleotide
acaattccggcgtcgtggtgtttgttaaactgac

SEQ ID NO: 829 - DNA, 34 bp, Artificial Sequence
  Description of Artificial Sequence: Synthetic spacer oligonucleotide
acttccatcgccagttgcgacattgctttgaatg

SEQ ID NO: 830 - DNA, 34 bp, Artificial Sequence
  Description of Artificial Sequence: Synthetic spacer oligonucleotide
accttcatacgctttgcggtaaagatgcggagcc

SEQ ID NO: 831 - DNA, 34 bp, Artificial Sequence
  Description of Artificial Sequence: Synthetic spacer oligonucleotide
acactcaaaggcccgaaaggcgaacctgctccgg

SEQ ID NO: 832 - DNA, 34 bp, Artificial Sequence
  Description of Artificial Sequence: Synthetic spacer oligonucleotide
accatgaagtcttcaagggacttcagggaatagc

SEQ ID NO: 833 - DNA, 34 bp, Artificial Sequence
  Description of Artificial Sequence: Synthetic spacer oligonucleotide
acttaatagatattcgcgctaatacaactcaatc

SEQ ID NO: 834 - DNA, 34 bp, Artificial Sequence
  Description of Artificial Sequence: Synthetic spacer oligonucleotide
acaggcgctcattctgaggatcggcgagtttatg

SEQ ID NO: 835 - DNA, 34 bp, Artificial Sequence
  Description of Artificial Sequence: Synthetic spacer oligonucleotide
acggcacgtcagactgacgtatcgctatacccca

SEQ ID NO: 836 - DNA, 34 bp, Artificial Sequence
  Description of Artificial Sequence: Synthetic spacer oligonucleotide
acatctccgcgttaaaaatcattccgcgctcttt

SEQ ID NO: 837 - DNA, 34 bp, Artificial Sequence
  Description of Artificial Sequence: Synthetic spacer oligonucleotide
acacgttggtgatagggagtggtggcaataaaat

SEQ ID NO: 838 - DNA, 34 bp, Artificial Sequence
  Description of Artificial Sequence: Synthetic spacer oligonucleotide
acgcgctggcggggtgggatgaggctgaggaaac

SEQ ID NO: 839 - DNA, 34 bp, Artificial Sequence
  Description of Artificial Sequence: Synthetic spacer oligonucleotide
acttactcgctctagtaataaggaaaatttatgc

SEQ ID NO: 840 - DNA, 34 bp, Artificial Sequence
  Description of Artificial Sequence: Synthetic spacer oligonucleotide
acgagggcgagccggaagtgctggaggttcgcgc

SEQ ID NO: 841 - DNA, 34 bp, Artificial Sequence
  Description of Artificial Sequence: Synthetic spacer oligonucleotide
acccggcaaacgatacgcagtcacgatcaatcac

SEQ ID NO: 842 - DNA, 34 bp, Artificial Sequence
  Description of Artificial Sequence: Synthetic spacer oligonucleotide
accatctcacgcgaggcgcggatttttgagccga

SEQ ID NO: 843 - DNA, 34 bp, Artificial Sequence
  Description of Artificial Sequence: Synthetic spacer oligonucleotide
actgtgtcgccggaagtcgctaccttgaatcttg

SEQ ID NO: 844 - DNA, 34 bp, Artificial Sequence
  Description of Artificial Sequence: Synthetic spacer oligonucleotide
acgtgcgttcaaataaatcgcgttggaatggata

SEQ ID NO: 845 - DNA, 34 bp, Artificial Sequence
  Description of Artificial Sequence: Synthetic spacer oligonucleotide
acgtcaacatccccgtaacatcttattttgtgct

SEQ ID NO: 846 - DNA, 34 bp, Artificial Sequence
  Description of Artificial Sequence: Synthetic spacer oligonucleotide
acaaaccatatccggctaccggtatggttcaggt

SEQ ID NO: 847 - DNA, 34 bp, Artificial Sequence
  Description of Artificial Sequence: Synthetic spacer oligonucleotide
acaagatgctgccggatactattaaaccggaaca

SEQ ID NO: 848 - DNA, 34 bp, Artificial Sequence
  Description of Artificial Sequence: Synthetic spacer oligonucleotide
acgccggtgcggtgttcgtcgtgaccgccgccac

SEQ ID NO: 849 - DNA, 34 bp, Artificial Sequence
  Description of Artificial Sequence: Synthetic spacer oligonucleotide
acaagtcagtgttgtcattgatctggtgggcaac

SEQ ID NO: 850 - DNA, 34 bp, Artificial Sequence
  Description of Artificial Sequence: Synthetic spacer oligonucleotide
acacgctgatgcccggcgacgggcggcgcacgct

SEQ ID NO: 851 - DNA, 35 bp, Artificial Sequence
  Description of Artificial Sequence: Synthetic spacer oligonucleotide
acgtcggcgaccacctgcggccacacctgagcgcc

SEQ ID NO: 852 - DNA, 34 bp, Artificial Sequence
  Description of Artificial Sequence: Synthetic spacer oligonucleotide
acagctatctcgacgtgaacacaatcgccacgct

SEQ ID NO: 853 - DNA, 34 bp, Artificial Sequence
  Description of Artificial Sequence: Synthetic spacer oligonucleotide
acgcgtcaaaccagaaacatgagtggcaaatcga

SEQ ID NO: 854 - DNA, 34 bp, Artificial Sequence
  Description of Artificial Sequence: Synthetic spacer oligonucleotide
acttcagaggctcgataccaggatgggatcgggc

SEQ ID NO: 855 - DNA, 34 bp, Artificial Sequence
  Description of Artificial Sequence: Synthetic spacer oligonucleotide
acacacccggttgcaatcaatggtctgggggctg

SEQ ID NO: 856 - DNA, 34 bp, Artificial Sequence
  Description of Artificial Sequence: Synthetic spacer oligonucleotide
acttgccgcgctggttgccgtgggctgaaaagta

SEQ ID NO: 857 - DNA, 34 bp, Artificial Sequence
  Description of Artificial Sequence: Synthetic spacer oligonucleotide
accagaccgtgggcgatctcattttgtgcccgac

SEQ ID NO: 858 - DNA, 34 bp, Artificial Sequence
  Description of Artificial Sequence: Synthetic spacer oligonucleotide
actcagcaattcgccgcaatcatttttttgctgc

SEQ ID NO: 859 - DNA, 34 bp, Artificial Sequence
  Description of Artificial Sequence: Synthetic spacer oligonucleotide
acttgatccagctcggcgatgcggcgttctgcgg

SEQ ID NO: 860 - DNA, 34 bp, Artificial Sequence
  Description of Artificial Sequence: Synthetic spacer oligonucleotide
accgttggctggagatatgggagtacctttggaa

SEQ ID NO: 861 - DNA, 34 bp, Artificial Sequence
  Description of Artificial Sequence: Synthetic spacer oligonucleotide
acttttaattaatgagaattagacgcaacattgt

SEQ ID NO: 862 - DNA, 34 bp, Artificial Sequence
  Description of Artificial Sequence: Synthetic spacer oligonucleotide
acgagcgaaggtgcaacattatcaccatattcgg

SEQ ID NO: 863 - DNA, 34 bp, Artificial Sequence
  Description of Artificial Sequence: Synthetic spacer oligonucleotide
acaatgtttcccgcacccaaatgcgatcgccagg

SEQ ID NO: 864 - DNA, 34 bp, Artificial Sequence
  Description of Artificial Sequence: Synthetic spacer oligonucleotide
acaatgataaattatccgttaccgcaataacaat

SEQ ID NO: 865 - DNA, 34 bp, Artificial Sequence
  Description of Artificial Sequence: Synthetic spacer oligonucleotide
accctgcgtagttgatcacgatttccgggataat

SEQ ID NO: 866 - DNA, 34 bp, Artificial Sequence
  Description of Artificial Sequence: Synthetic spacer oligonucleotide
acttttttcttcggtgcccaaccgcagcctaacg

SEQ ID NO: 867 - DNA, 34 bp, Artificial Sequence
  Description of Artificial Sequence: Synthetic spacer oligonucleotide
acttatagagttgactcaaattcatttttattcc

SEQ ID NO: 868 - DNA, 34 bp, Artificial Sequence
  Description of Artificial Sequence: Synthetic spacer oligonucleotide
actagccgggtctgtatcgaataccagccccgcg

SEQ ID NO: 869 - DNA, 34 bp, Artificial Sequence
  Description of Artificial Sequence: Synthetic spacer oligonucleotide
actaaaattggcatcatagatggtttgatagtcc

SEQ ID NO: 870 - DNA, 34 bp, Artificial Sequence
  Description of Artificial Sequence: Synthetic spacer oligonucleotide
acatgcaatggggaataagtggcgggtaaatcaa

SEQ ID NO: 871 - DNA, 34 bp, Artificial Sequence
  Description of Artificial Sequence: Synthetic spacer oligonucleotide
acgaggtggcaaaatattgtcagcgggatttttt

SEQ ID NO: 872 - DNA, 34 bp, Artificial Sequence
  Description of Artificial Sequence: Synthetic spacer oligonucleotide
acccgtcgccgcacgcaaacaatccgggcgccca

SEQ ID NO: 873 - DNA, 34 bp, Artificial Sequence
  Description of Artificial Sequence: Synthetic spacer oligonucleotide
actcaataaccccttttaaatactgccgttccag

SEQ ID NO: 874 - DNA, 34 bp, Artificial Sequence
  Description of Artificial Sequence: Synthetic spacer oligonucleotide
actttacaattacggtccctattccctcagtcct

SEQ ID NO: 875 - DNA, 34 bp, Artificial Sequence
  Description of Artificial Sequence: Synthetic spacer oligonucleotide
accgcgcacggcgtttgccctcgtcggttattgg

SEQ ID NO: 876 - DNA, 34 bp, Artificial Sequence
  Description of Artificial Sequence: Synthetic spacer oligonucleotide
acctgattgtcaaaatcaaaaaacaggccgagtc

SEQ ID NO: 877 - skipped

SEQ ID NO: 878 - DNA, 34 bp, Artificial Sequence
  Description of Artificial Sequence: Synthetic spacer oligonucleotide
actttaccaatctgtaaatatttttcatctgctg

SEQ ID NO: 879 - DNA, 34 bp, Artificial Sequence
  Description of Artificial Sequence: Synthetic spacer oligonucleotide
acagttcgctctcgatcgtcgcggcatacatcgc

SEQ ID NO: 880 - DNA, 34 bp, Artificial Sequence
  Description of Artificial Sequence: Synthetic spacer oligonucleotide
acgattgcacagggggtgagtatggaacagctga

SEQ ID NO: 881 - DNA, 34 bp, Artificial Sequence
  Description of Artificial Sequence: Synthetic spacer oligonucleotide
acaatactgacgtgtttcacgctgctgccgtctg

SEQ ID NO: 882 - DNA, 34 bp, Artificial Sequence
  Description of Artificial Sequence: Synthetic spacer oligonucleotide
acccaacagtaattgcaaaatcctgttgtttaat

SEQ ID NO: 883 - DNA, 34 bp, Artificial Sequence
  Description of Artificial Sequence: Synthetic spacer oligonucleotide
acgggatcagcaccgacaacctaaaaccactgtt

SEQ ID NO: 884 - DNA, 34 bp, Artificial Sequence
  Description of Artificial Sequence: Synthetic spacer oligonucleotide
actgtgtcggaatatgcgggctgattttcgtctg

SEQ ID NO: 885 - DNA, 34 bp, Artificial Sequence
  Description of Artificial Sequence: Synthetic spacer oligonucleotide
acgaaccgcttttatttttagacatagagcaccg

SEQ ID NO: 886 - DNA, 34 bp, Artificial Sequence
  Description of Artificial Sequence: Synthetic spacer oligonucleotide
acaaactctgggcgctcgaatggctgtcctattg

SEQ ID NO: 887 - DNA, 34 bp, Artificial Sequence
  Description of Artificial Sequence: Synthetic spacer oligonucleotide
actggcggtgtaaatttttacgtttttcatatct

SEQ ID NO: 888 - DNA, 34 bp, Artificial Sequence
  Description of Artificial Sequence: Synthetic spacer oligonucleotide
acgagacttttcacactgataatgttgttatttt

SEQ ID NO: 889 - DNA, 34 bp, Artificial Sequence
  Description of Artificial Sequence: Synthetic spacer oligonucleotide
acgttgtcgcggtagtatttagtcgaaagcatga

SEQ ID NO: 890 - DNA, 34 bp, Artificial Sequence
  Description of Artificial Sequence: Synthetic spacer oligonucleotide
acacggcctgatttagagttaaacatggtcacgc

SEQ ID NO: 891 - DNA, 34 bp, Artificial Sequence
  Description of Artificial Sequence: Synthetic spacer oligonucleotide
actacgggttgtaccatgccactggcgttttgtg

SEQ ID NO: 892 - DNA, 34 bp, Artificial Sequence
  Description of Artificial Sequence: Synthetic spacer oligonucleotide
acatggcgtgtctcgattgcgcgctgccgcactg

SEQ ID NO: 893 - DNA, 34 bp, Artificial Sequence
  Description of Artificial Sequence: Synthetic spacer oligonucleotide
acttcccatttagcgagttcttttgccgccagca

SEQ ID NO: 894 - DNA, 34 bp, Artificial Sequence
  Description of Artificial Sequence: Synthetic spacer oligonucleotide
accggattttttagagggaaaagaacatggcccg

SEQ ID NO: 895 - DNA, 34 bp, Artificial Sequence
  Description of Artificial Sequence: Synthetic spacer oligonucleotide
acagtcgtttagtgatattcctcgttgctgtagg

SEQ ID NO: 896 - DNA, 34 bp, Artificial Sequence
  Description of Artificial Sequence: Synthetic spacer oligonucleotide
acgccacccggacaacaaaatgaatcccgatgat

SEQ ID NO: 897 - DNA, 34 bp, Artificial Sequence
  Description of Artificial Sequence: Synthetic spacer oligonucleotide
actactatatgaatgcaaaaacgaaaaacatggc

SEQ ID NO: 898 - DNA, 34 bp, Artificial Sequence
  Description of Artificial Sequence: Synthetic spacer oligonucleotide
acctttcttgaactcttcaaagttgagccattcg

SEQ ID NO: 899 - DNA, 34 bp, Artificial Sequence
  Description of Artificial Sequence: Synthetic spacer oligonucleotide
acccatttgtttatttaacttctcctgatcggcg

SEQ ID NO: 900 - DNA, 34 bp, Artificial Sequence
  Description of Artificial Sequence: Synthetic spacer oligonucleotide
acggcatcagaccactcgtcgtgctcgctgcgaa

SEQ ID NO: 901 - DNA, 34 bp, Artificial Sequence
  Description of Artificial Sequence: Synthetic spacer oligonucleotide
acggtgacgcccccttccttgctcataaaacccc

SEQ ID NO: 902 - DNA, 34 bp, Artificial Sequence
  Description of Artificial Sequence: Synthetic spacer oligonucleotide
accgtagtcagtgagagaaatattaacaagtccc

SEQ ID NO: 903 - DNA, 34 bp, Artificial Sequence
  Description of Artificial Sequence: Synthetic spacer oligonucleotide
actgcaaacgacatagccaccaggtcagtggcgt

SEQ ID NO: 904 - DNA, 34 bp, Artificial Sequence
  Description of Artificial Sequence: Synthetic spacer oligonucleotide
acaaaataataccagatataataccgatatcggc

SEQ ID NO: 905 - DNA, 34 bp, Artificial Sequence
  Description of Artificial Sequence: Synthetic spacer oligonucleotide
acttcctgtaacattccgatatataattctccgc

SEQ ID NO: 906 - DNA, 32 bp, Artificial Sequence
  Description of Artificial Sequence: Synthetic spacer oligonucleotide
ggtagttaccctcgttcagttttttgagcaac

SEQ ID NO: 907 - DNA, 34 bp, Artificial Sequence
  Description of Artificial Sequence: Synthetic spacer oligonucleotide
acttcaaactgcttgcggtaagaaactgttgcac

SEQ ID NO: 908 - DNA, 34 bp, Artificial Sequence
  Description of Artificial Sequence: Synthetic spacer oligonucleotide
actagcgaataatggttgtgtttaagtggatatt

SEQ ID NO: 909 - DNA, 34 bp, Artificial Sequence
  Description of Artificial Sequence: Synthetic spacer oligonucleotide
acttaacccaagccactagcggcgacaacacaat

SEQ ID NO: 910 - DNA, 34 bp, Artificial Sequence
  Description of Artificial Sequence: Synthetic spacer oligonucleotide
actgcactcccgaccgttgaggtgacaaaaccct

SEQ ID NO: 911 - DNA, 34 bp, Artificial Sequence
  Description of Artificial Sequence: Synthetic spacer oligonucleotide
acaacccttacggttatatgaaagaagattttta

SEQ ID NO: 912 - DNA, 34 bp, Artificial Sequence
  Description of Artificial Sequence: Synthetic spacer oligonucleotide
accggcatatcaggagttggagcaaccagcgaga

SEQ ID NO: 913 - DNA, 34 bp, Artificial Sequence
  Description of Artificial Sequence: Synthetic spacer oligonucleotide
actgacctgaagaaataacattgactccaaactg

SEQ ID NO: 914 - DNA, 34 bp, Artificial Sequence
  Description of Artificial Sequence: Synthetic spacer oligonucleotide
acgttttctctacatttagctatagacgttagtt

SEQ ID NO: 915 - DNA, 34 bp, Artificial Sequence
  Description of Artificial Sequence: Synthetic spacer oligonucleotide
actggcctgactttatcaagcagtgcatactgac

SEQ ID NO: 916 - DNA, 34 bp, Artificial Sequence
  Description of Artificial Sequence: Synthetic spacer oligonucleotide
accctgtttcaggttactacctaatccgttaagg

SEQ ID NO: 917 - DNA, 34 bp, Artificial Sequence
  Description of Artificial Sequence: Synthetic spacer oligonucleotide
accctgtttcaggttactacctaatccgttaggg

SEQ ID NO: 918 - DNA, 34 bp, Artificial Sequence
  Description of Artificial Sequence: Synthetic spacer oligonucleotide
acgttaccgttggcgtaacgctgaattgttggta

SEQ ID NO: 919 - DNA, 34 bp, Artificial Sequence
  Description of Artificial Sequence: Synthetic spacer oligonucleotide
acctgagaggaaccagggaaagatgttttgggat

SEQ ID NO: 920 - DNA, 34 bp, Artificial Sequence
  Description of Artificial Sequence: Synthetic spacer oligonucleotide
actgcctgaaactttccatgaactggctgtaacg

SEQ ID NO: 921 - DNA, 34 bp, Artificial Sequence
  Description of Artificial Sequence: Synthetic spacer oligonucleotide
acaattattccctcccatgcaccctgttctcacc

SEQ ID NO: 922 - DNA, 34 bp, Artificial Sequence
  Description of Artificial Sequence: Synthetic spacer oligonucleotide
accccttcgctctcgatccagtgctgcgcatgag

SEQ ID NO: 923 - DNA, 34 bp, Artificial Sequence
  Description of Artificial Sequence: Synthetic spacer oligonucleotide
acccaattcaatcccttgttgaccttagtaaatc

SEQ ID NO: 924 - DNA, 34 bp, Artificial Sequence
  Description of Artificial Sequence: Synthetic spacer oligonucleotide
actcacgcatcgcctgttgcgcgccctcatacgc

SEQ ID NO: 925 - DNA, 34 bp, Artificial Sequence
  Description of Artificial Sequence: Synthetic spacer oligonucleotide
acggggcttgattgcctaaacaaacttttctggg

SEQ ID NO: 926 - DNA, 35 bp, Artificial Sequence
  Description of Artificial Sequence: Synthetic spacer oligonucleotide
acgaatcattctgtcacgaacaattatattttctc

SEQ ID NO: 927 - DNA, 34 bp, Artificial Sequence
  Description of Artificial Sequence: Synthetic spacer oligonucleotide
acgacatttgacactatgcgcgatgatgcaatcg

SEQ ID NO: 928 - DNA, 34 bp, Artificial Sequence
  Description of Artificial Sequence: Synthetic spacer oligonucleotide
acctcattacgatgtgacgcaataccgtgctgtc

SEQ ID NO: 929 - DNA, 34 bp, Artificial Sequence
  Description of Artificial Sequence: Synthetic spacer oligonucleotide
acagcattttctttgctggcccccatttggtgta

SEQ ID NO: 930 - DNA, 34 bp, Artificial Sequence
  Description of Artificial Sequence: Synthetic spacer oligonucleotide
acacgtagccggtacaactgacgcagtagacgtg

SEQ ID NO: 931 - DNA, 34 bp, Artificial Sequence
  Description of Artificial Sequence: Synthetic spacer oligonucleotide
accgtttacgtttgccgacgatttaactaaacag

SEQ ID NO: 932 - DNA, 34 bp, Artificial Sequence
  Description of Artificial Sequence: Synthetic spacer oligonucleotide
acagcgccgccctcgcgtagaaagtgttcgtgtg

SEQ ID NO: 933 - DNA, 34 bp, Artificial Sequence
  Description of Artificial Sequence: Synthetic spacer oligonucleotide
acacggcaacggatgcgaccgccagcgcgatccc

SEQ ID NO: 934 - DNA, 34 bp, Artificial Sequence
  Description of Artificial Sequence: Synthetic spacer oligonucleotide
acacggcaacggatgcgaccgccaacgcgatccc

SEQ ID NO: 935 - DNA, 34 bp, Artificial Sequence
  Description of Artificial Sequence: Synthetic spacer oligonucleotide
actgttcgagttgcgccggtgatttgaaatcttc

SEQ ID NO: 936 - DNA, 34 bp, Artificial Sequence
  Description of Artificial Sequence: Synthetic spacer oligonucleotide
acgatggcctgtttttcaacgaaagagaagaatt

SEQ ID NO: 937 - DNA, 34 bp, Artificial Sequence
  Description of Artificial Sequence: Synthetic spacer oligonucleotide
actgatgcaggcgtttacgtactgcgagatgaag

SEQ ID NO: 938 - DNA, 34 bp, Artificial Sequence
  Description of Artificial Sequence: Synthetic spacer oligonucleotide
actgtcaccacgggcggtagagtgtgccgccagg

SEQ ID NO: 939 - DNA, 34 bp, Artificial Sequence
  Description of Artificial Sequence: Synthetic spacer oligonucleotide
actaggcaacttatcggattctaaaaaggaaatt

SEQ ID NO: 940 - DNA, 34 bp, Artificial Sequence
  Description of Artificial Sequence: Synthetic spacer oligonucleotide
acggacaaagccgtcacctttgaccagcacgccc

SEQ ID NO: 941 - DNA, 34 bp, Artificial Sequence
  Description of Artificial Sequence: Synthetic spacer oligonucleotide
acgatttttcgccagccactccagccagtgctgc

SEQ ID NO: 942 - DNA, 34 bp, Artificial Sequence
  Description of Artificial Sequence: Synthetic spacer oligonucleotide
actagcaatggaaatatttgcatggatagttgcg

SEQ ID NO: 943 - DNA, 34 bp, Artificial Sequence
  Description of Artificial Sequence: Synthetic spacer oligonucleotide
actatgaaacgctccctcaccgagcagcggcaaa

SEQ ID NO: 944 - DNA, 34 bp, Artificial Sequence
  Description of Artificial Sequence: Synthetic spacer oligonucleotide
acccagccagtagtgggaaaatgtcactctcggt

SEQ ID NO: 945 - DNA, 34 bp, Artificial Sequence
  Description of Artificial Sequence: Synthetic spacer oligonucleotide
acgtccaccgataaaaacgggcgttgccgcacaa

SEQ ID NO: 946 - DNA, 34 bp, Artificial Sequence
  Description of Artificial Sequence: Synthetic spacer oligonucleotide
accggggcatcaatacgcgcaaccgggtagccct

SEQ ID NO: 947 - DNA, 34 bp, Artificial Sequence
  Description of Artificial Sequence: Synthetic spacer oligonucleotide
acagctcaggcccgcaccgaaacaacgctcgata

SEQ ID NO: 948 - DNA, 34 bp, Artificial Sequence
  Description of Artificial Sequence: Synthetic spacer oligonucleotide
acatattgatactgttctcaagcgccgttttagc

SEQ ID NO: 949 - DNA, 34 bp, Artificial Sequence
  Description of Artificial Sequence: Synthetic spacer oligonucleotide
acaacacggcggcaatatcgcgcccctgactggg

SEQ ID NO: 950 - DNA, 34 bp, Artificial Sequence
  Description of Artificial Sequence: Synthetic spacer oligonucleotide
accgcaaccgctagatgaccgacaacgagaatgg

SEQ ID NO: 951 - DNA, 34 bp, Artificial Sequence
  Description of Artificial Sequence: Synthetic spacer oligonucleotide
acaacaacagagcagatcctgaagtatgaccgcg

SEQ ID NO: 952 - DNA, 34 bp, Artificial Sequence
  Description of Artificial Sequence: Synthetic spacer oligonucleotide
acatattcgtcgttaataccagtgcattcaaatt

SEQ ID NO: 953 - DNA, 34 bp, Artificial Sequence
  Description of Artificial Sequence: Synthetic spacer oligonucleotide
acactcaaaaggccagtaccaaggcggcgctcac

SEQ ID NO: 954 - DNA, 34 bp, Artificial Sequence
  Description of Artificial Sequence: Synthetic spacer oligonucleotide
actcgtgaatcgtagcgcttccccactagcaagg

SEQ ID NO: 955 - DNA, 34 bp, Artificial Sequence
  Description of Artificial Sequence: Synthetic spacer oligonucleotide
actggttgatgattttgttattcgccctcagcag

SEQ ID NO: 956 - DNA, 34 bp, Artificial Sequence
  Description of Artificial Sequence: Synthetic spacer oligonucleotide
accgtgttcggcttcttcaacgtcgtctttatcc

SEQ ID NO: 957 - DNA, 34 bp, Artificial Sequence
  Description of Artificial Sequence: Synthetic spacer oligonucleotide
acttaaaagttttatcgccgtagcctattgctaa

SEQ ID NO: 958 - DNA, 34 bp, Artificial Sequence
  Description of Artificial Sequence: Synthetic spacer oligonucleotide
accgtataaatattgagtaataccgccgaccggc

SEQ ID NO: 959 - DNA, 34 bp, Artificial Sequence
  Description of Artificial Sequence: Synthetic spacer oligonucleotide
actcgatcagcgcgtcagccgtagttgcaatact

SEQ ID NO: 960 - DNA, 34 bp, Artificial Sequence
  Description of Artificial Sequence: Synthetic spacer oligonucleotide
actcgggcgctcaaaaccgcaaacagacggcggg

SEQ ID NO: 961 - DNA, 34 bp, Artificial Sequence
  Description of Artificial Sequence: Synthetic spacer oligonucleotide
acgccttcctgtaattcagcatacttcgacgtac

SEQ ID NO: 962 - DNA, 34 bp, Artificial Sequence
  Description of Artificial Sequence: Synthetic spacer oligonucleotide
actgcaggtgctgtcgcgtcggcgattttgatgt

SEQ ID NO: 963 - DNA, 34 bp, Artificial Sequence
  Description of Artificial Sequence: Synthetic spacer oligonucleotide
actgcctacgtcaccgatcgagatcaggccgggg

SEQ ID NO: 964 - DNA, 34 bp, Artificial Sequence
  Description of Artificial Sequence: Synthetic spacer oligonucleotide
actccagacacgtctgcaaaacagactcgtttgc

SEQ ID NO: 965 - DNA, 35 bp, Artificial Sequence
  Description of Artificial Sequence: Synthetic spacer oligonucleotide
acgcggacaatagctatctcgacagtgaaacgttg

SEQ ID NO: 966 - DNA, 34 bp, Artificial Sequence
  Description of Artificial Sequence: Synthetic spacer oligonucleotide
acaaaaggccagccgaggtcttcggaaacatacc

SEQ ID NO: 967 - DNA, 34 bp, Artificial Sequence
  Description of Artificial Sequence: Synthetic spacer oligonucleotide
acacaatatttgcaacgacccgacgagatagctc

SEQ ID NO: 968 - DNA, 34 bp, Artificial Sequence
  Description of Artificial Sequence: Synthetic spacer oligonucleotide
acgtttggtaacggatatccagaagaggtgttta

SEQ ID NO: 969 - DNA, 34 bp, Artificial Sequence
  Description of Artificial Sequence: Synthetic spacer oligonucleotide
acagatatgcggaatcaccaacaacacgcgcgcc

SEQ ID NO: 970 - DNA, 34 bp, Artificial Sequence
  Description of Artificial Sequence: Synthetic spacer oligonucleotide
acagctgtaagttttagccacgcctcccagatgt

SEQ ID NO: 971 - DNA, 34 bp, Artificial Sequence
  Description of Artificial Sequence: Synthetic spacer oligonucleotide
accgcagttagcgacggactcagccaggcgatgc

SEQ ID NO: 972 - DNA, 34 bp, Artificial Sequence
  Description of Artificial Sequence: Synthetic spacer oligonucleotide
actaactcatcacatccgcgtcagacctcgtgac

SEQ ID NO: 973 - DNA, 34 bp, Artificial Sequence
  Description of Artificial Sequence: Synthetic spacer oligonucleotide
acgttatgatttgtattgtaatataattaacgaa

SEQ ID NO: 974 - DNA, 34 bp, Artificial Sequence
  Description of Artificial Sequence: Synthetic spacer oligonucleotide
actgagtggatattaaacggaccttacagcccca

SEQ ID NO: 975 - DNA, 34 bp, Artificial Sequence
  Description of Artificial Sequence: Synthetic spacer oligonucleotide
acggaaggaagctaagcaagcccttctctcaatc

SEQ ID NO: 976 - DNA, 34 bp, Artificial Sequence
  Description of Artificial Sequence: Synthetic spacer oligonucleotide
acgggcaatatgctctggatcgtcatgatcaccc

SEQ ID NO: 977 - DNA, 34 bp, Artificial Sequence
  Description of Artificial Sequence: Synthetic spacer oligonucleotide
acattgtgtctcatgagaatcatcaacctgagcc

SEQ ID NO: 978 - DNA, 34 bp, Artificial Sequence
  Description of Artificial Sequence: Synthetic spacer oligonucleotide
acttccgtatcgagaccactgatcgcttccgctg

SEQ ID NO: 979 - DNA, 34 bp, Artificial Sequence
  Description of Artificial Sequence: Synthetic spacer oligonucleotide
acgtctcccccctgagtaactcctttcgataatt

SEQ ID NO: 980 - DNA, 34 bp, Artificial Sequence
  Description of Artificial Sequence: Synthetic spacer oligonucleotide
actaattgctcctgatccattgtggttgtggcaa

SEQ ID NO: 981 - DNA, 34 bp, Artificial Sequence
  Description of Artificial Sequence: Synthetic spacer oligonucleotide
acatcccgaatccggggatgcggttgcaaaacag

SEQ ID NO: 982 - DNA, 34 bp, Artificial Sequence
  Description of Artificial Sequence: Synthetic spacer oligonucleotide
accatttttgtatttgtttctatggcggatcata

SEQ ID NO: 983 - DNA, 34 bp, Artificial Sequence
  Description of Artificial Sequence: Synthetic spacer oligonucleotide
acagcaaactcagtggcagcggcggtgcagtttt

SEQ ID NO: 984 - DNA, 34 bp, Artificial Sequence
  Description of Artificial Sequence: Synthetic spacer oligonucleotide
actaagcgcgaaattgaaaggggatcagaagggg

SEQ ID NO: 985 - DNA, 34 bp, Artificial Sequence
  Description of Artificial Sequence: Synthetic spacer oligonucleotide
acgttgtccggcgttaaaacaagtttgccgatcc

SEQ ID NO: 986 - DNA, 34 bp, Artificial Sequence
  Description of Artificial Sequence: Synthetic spacer oligonucleotide
acgataaaacaaaccaggcggcagcagatgaata

SEQ ID NO: 987 - DNA, 33 bp, Artificial Sequence
  Description of Artificial Sequence: Synthetic spacer oligonucleotide
acatgcggattaaaatccgttttcggccagcgt

SEQ ID NO: 988 - DNA, 34 bp, Artificial Sequence
  Description of Artificial Sequence: Synthetic spacer oligonucleotide
acatgcggattgaaaatccgttttcggccagcgt

SEQ ID NO: 989 - DNA, 34 bp, Artificial Sequence
  Description of Artificial Sequence: Synthetic spacer oligonucleotide
acgacaacgcatcaagaccgatatacaccacgcc

SEQ ID NO: 990 - DNA, 34 bp, Artificial Sequence
  Description of Artificial Sequence: Synthetic spacer oligonucleotide
acacagtgaagaataagcggctgcgccgaaacgg

SEQ ID NO: 991 - DNA, 34 bp, Artificial Sequence
  Description of Artificial Sequence: Synthetic spacer oligonucleotide
acaggggaaaattaacaatggcgaatctgaatcg

SEQ ID NO: 992 - DNA, 34 bp, Artificial Sequence
  Description of Artificial Sequence: Synthetic spacer oligonucleotide
actcgtagtcttccgggtaggcgttttcatccgg

SEQ ID NO: 993 - DNA, 34 bp, Artificial Sequence
  Description of Artificial Sequence: Synthetic spacer oligonucleotide
actcagcctcaaaccggatgtaacgcgctaacgc

SEQ ID NO: 994 - DNA, 34 bp, Artificial Sequence
  Description of Artificial Sequence: Synthetic spacer oligonucleotide
acacgggtgagcgctgccggggtggtaatccttc

SEQ ID NO: 995 - DNA, 34 bp, Artificial Sequence
  Description of Artificial Sequence: Synthetic spacer oligonucleotide
acgtaacttaataaggtcctggacattaattttg

SEQ ID NO: 996 - DNA, 35 bp, Artificial Sequence
  Description of Artificial Sequence: Synthetic spacer oligonucleotide
acccgctgactgaaaatgacgacgtaccggaaggc

SEQ ID NO: 997 - DNA, 34 bp, Artificial Sequence
  Description of Artificial Sequence: Synthetic spacer oligonucleotide
actggcgggccttgtttatcgccagcttttcaat

SEQ ID NO: 998 - DNA, 34 bp, Artificial Sequence
  Description of Artificial Sequence: Synthetic spacer oligonucleotide
actgtttttatacagttttacatgatactgtaac

SEQ ID NO: 999 - DNA, 34 bp, Artificial Sequence
  Description of Artificial Sequence: Synthetic spacer oligonucleotide
actccggatgtctccccccgcgccgtttgaatat

SEQ ID NO: 1000 - DNA, 34 bp, Artificial Sequence
  Description of Artificial Sequence: Synthetic spacer oligonucleotide
acggcatgatacgcgctgacgaaacgttatccga

SEQ ID NO: 1001 - DNA, 34 bp, Artificial Sequence
  Description of Artificial Sequence: Synthetic spacer oligonucleotide
actttcaccctgcctgtagatgcgaggaaaatag

SEQ ID NO: 1002 - DNA, 34 bp, Artificial Sequence
  Description of Artificial Sequence: Synthetic spacer oligonucleotide
actccaacctgagcttcaggaggaagtgtccaac

SEQ ID NO: 1003 - DNA, 34 bp, Artificial Sequence
  Description of Artificial Sequence: Synthetic spacer oligonucleotide
actatgccgccccggcgtacagcgacaggcgggc

SEQ ID NO: 1004 - DNA, 34 bp, Artificial Sequence
  Description of Artificial Sequence: Synthetic spacer oligonucleotide
acggccgtctgcattgagcgcagttttaacgcgt

SEQ ID NO: 1005 - DNA, 34 bp, Artificial Sequence
  Description of Artificial Sequence: Synthetic spacer oligonucleotide
actcttccggtgggttttcttgtccgtcgatggc

SEQ ID NO: 1006 - DNA, 34 bp, Artificial Sequence
  Description of Artificial Sequence: Synthetic spacer oligonucleotide
acatctaaccggctgcaatgctcaggcattacag

SEQ ID NO: 1007 - DNA, 34 bp, Artificial Sequence
  Description of Artificial Sequence: Synthetic spacer oligonucleotide
acgtgtttttctgcattgcggcctcagtgaatgc

SEQ ID NO: 1008 - DNA, 34 bp, Artificial Sequence
  Description of Artificial Sequence: Synthetic spacer oligonucleotide
actctctgttagcggtgccgcttccatttcagac

SEQ ID NO: 1009 - DNA, 34 bp, Artificial Sequence
  Description of Artificial Sequence: Synthetic spacer oligonucleotide
actcagcaccgctggtatagagaaagcgctaagc

SEQ ID NO: 1010 - DNA, 34 bp, Artificial Sequence
  Description of Artificial Sequence: Synthetic spacer oligonucleotide
acaaatgtttggagtgtttcccatgattgaaaaa

SEQ ID NO: 1011 - DNA, 29 bp, Artificial Sequence
  Description of Artificial Sequence: Synthetic spacer oligonucleotide
acaaatggatgccaggcaagccgcccacc

SEQ ID NO: 1012 - DNA, 34 bp, Artificial Sequence
  Description of Artificial Sequence: Synthetic spacer oligonucleotide
actcagtagtgacgacgtaccacaatttacggcg

SEQ ID NO: 1013 - DNA, 34 bp, Artificial Sequence
  Description of Artificial Sequence: Synthetic spacer oligonucleotide
acaggacgggaatattgttgaaggttgaaactgc

SEQ ID NO: 1014 - DNA, 34 bp, Artificial Sequence
  Description of Artificial Sequence: Synthetic spacer oligonucleotide
acatttctgtggaggttatttttttattttttat

SEQ ID NO: 1015 - DNA, 34 bp, Artificial Sequence
  Description of Artificial Sequence: Synthetic spacer oligonucleotide
acactcgcgggaattcccctcattgcaaagccgc

SEQ ID NO: 1016 - DNA, 32 bp, Artificial Sequence
  Description of Artificial Sequence: Synthetic spacer oligonucleotide
cgctgggttgcatcagccagctccagcatatc

SEQ ID NO: 1017 - DNA, 32 bp, Artificial Sequence
  Description of Artificial Sequence: Synthetic spacer oligonucleotide
caacactgacgctgaccgcaaaacatgccggg

SEQ ID NO: 1018 - DNA, 34 bp, Artificial Sequence
  Description of Artificial Sequence: Synthetic spacer oligonucleotide
acggccagcattcggtttgctacaaagtaagcgc

SEQ ID NO: 1019 - DNA, 32 bp, Artificial Sequence
  Description of Artificial Sequence: Synthetic spacer oligonucleotide
gtcacccaacgacgccactgcgtcatcgaata

SEQ ID NO: 1020 - DNA, 34 bp, Artificial Sequence
  Description of Artificial Sequence: Synthetic spacer oligonucleotide
acgttaccaaactgaatcagtgttgactgtccca

SEQ ID NO: 1021 - DNA, 34 bp, Artificial Sequence
  Description of Artificial Sequence: Synthetic spacer oligonucleotide
acttttataaataatgtatacatgaatgtattac

SEQ ID NO: 1022 - DNA, 34 bp, Artificial Sequence
  Description of Artificial Sequence: Synthetic spacer oligonucleotide
acagaagcattgataacttaggaatccagtctcg

SEQ ID NO: 1023 - DNA, 34 bp, Artificial Sequence
  Description of Artificial Sequence: Synthetic spacer oligonucleotide
acgtgaattaatttattgtcgcggcggctgtggc

SEQ ID NO: 1024 - DNA, 34 bp, Artificial Sequence
  Description of Artificial Sequence: Synthetic spacer oligonucleotide
actatttgtacagctttgggtttgccatatctgc

SEQ ID NO: 1025 - DNA, 34 bp, Artificial Sequence
  Description of Artificial Sequence: Synthetic spacer oligonucleotide
acctgtcggctgtgtcctgagtgatggtcatgtt

SEQ ID NO: 1026 - DNA, 34 bp, Artificial Sequence
  Description of Artificial Sequence: Synthetic spacer oligonucleotide
acttaatgccctgttgcgaacgggttattcggcg

SEQ ID NO: 1027 - DNA, 34 bp, Artificial Sequence
  Description of Artificial Sequence: Synthetic spacer oligonucleotide
acgcggagatccccagcaattcacgctgcgggta

SEQ ID NO: 1028 - DNA, 34 bp, Artificial Sequence
  Description of Artificial Sequence: Synthetic spacer oligonucleotide
acaaaggcaacggcaaacggcactgtttcgccgc

SEQ ID NO: 1029 - DNA, 34 bp, Artificial Sequence
  Description of Artificial Sequence: Synthetic spacer oligonucleotide
acccaccagacgcgcatgcctggttcaagcagaa

SEQ ID NO: 1030 - DNA, 34 bp, Artificial Sequence
  Description of Artificial Sequence: Synthetic spacer oligonucleotide
acttgccagtcccgttaccggaagaccattaagg

SEQ ID NO: 1031 - DNA, 34 bp, Artificial Sequence
  Description of Artificial Sequence: Synthetic spacer oligonucleotide
actcatcgcaatacatcctccacactgattaacc

SEQ ID NO: 1032 - DNA, 34 bp, Artificial Sequence
  Description of Artificial Sequence: Synthetic spacer oligonucleotide
acatgcagcaatacaccaggtcgaagaactggag

SEQ ID NO: 1033 - DNA, 34 bp, Artificial Sequence
  Description of Artificial Sequence: Synthetic spacer oligonucleotide
actccagctcatcacgggtaaaatcacgtccatt

SEQ ID NO: 1034 - DNA, 34 bp, Artificial Sequence
  Description of Artificial Sequence: Synthetic spacer oligonucleotide
acacaactggcggctcatcctcatcgagttcgtt

SEQ ID NO: 1035 - DNA, 34 bp, Artificial Sequence
  Description of Artificial Sequence: Synthetic spacer oligonucleotide
acactaatcaaactattaatataggtatcagttt

SEQ ID NO: 1036 - DNA, 34 bp, Artificial Sequence
  Description of Artificial Sequence: Synthetic spacer oligonucleotide
acaaaaattcgaatccccgcgcgtccgtttatgt

SEQ ID NO: 1037 - DNA, 34 bp, Artificial Sequence
  Description of Artificial Sequence: Synthetic spacer oligonucleotide
accgtttctggctctttgttgctgttcgtcttga

SEQ ID NO: 1038 - DNA, 34 bp, Artificial Sequence
  Description of Artificial Sequence: Synthetic spacer oligonucleotide
acgaacaatcatactctgcatcagatattgaggt

SEQ ID NO: 1039 - DNA, 36 bp, Artificial Sequence
  Description of Artificial Sequence: Synthetic spacer oligonucleotide
acggttaaagaagaggtcggattacatgttaatccc

SEQ ID NO: 1040 - DNA, 34 bp, Artificial Sequence
  Description of Artificial Sequence: Synthetic spacer oligonucleotide
acctccgctggttgtaaagcgcctgtgcgctcat

SEQ ID NO: 1041 - DNA, 34 bp, Artificial Sequence
  Description of Artificial Sequence: Synthetic spacer oligonucleotide
actagaccatccgagagataaaaacggaaatgtt

SEQ ID NO: 1042 - DNA, 34 bp, Artificial Sequence
  Description of Artificial Sequence: Synthetic spacer oligonucleotide
acttaatcaatagggtcagactgccagcagcgtt

SEQ ID NO: 1043 - DNA, 34 bp, Artificial Sequence
  Description of Artificial Sequence: Synthetic spacer oligonucleotide
actcatcgtaattccttttattttaaccgctaca

SEQ ID NO: 1044 - skipped

SEQ ID NO: 1045 - DNA, 34 bp, Artificial Sequence
  Description of Artificial Sequence: Synthetic spacer oligonucleotide
actgctgtagcgtggcgatttttgagatgatcgc

SEQ ID NO: 1046 - DNA, 34 bp, Artificial Sequence
  Description of Artificial Sequence: Synthetic spacer oligonucleotide
actttggtttacccccgattaccgggaaaaaggc

SEQ ID NO: 1047 - DNA, 34 bp, Artificial Sequence
  Description of Artificial Sequence: Synthetic spacer oligonucleotide
actgtcgtcgagctgcatatggcggcaaaaatgg

SEQ ID NO: 1048 - DNA, 34 bp, Artificial Sequence
  Description of Artificial Sequence: Synthetic spacer oligonucleotide
actgctggtacacttctgcataccgggcagtcgc

SEQ ID NO: 1049 - DNA, 34 bp, Artificial Sequence
  Description of Artificial Sequence: Synthetic spacer oligonucleotide
acacagacagtttattaacaatagatacaaattc

SEQ ID NO: 1050 - DNA, 34 bp, Artificial Sequence
  Description of Artificial Sequence: Synthetic spacer oligonucleotide
acgtttacagtgacagaactggatttaaagcgca

SEQ ID NO: 1051 - DNA, 34 bp, Artificial Sequence
  Description of Artificial Sequence: Synthetic spacer oligonucleotide
acgaataaagttgagttaagggtcaataacaaga

SEQ ID NO: 1052 - DNA, 34 bp, Artificial Sequence
  Description of Artificial Sequence: Synthetic spacer oligonucleotide
acgaccatgaacggttccaccacggtcgccgtaa

SEQ ID NO: 1053 - DNA, 34 bp, Artificial Sequence
  Description of Artificial Sequence: Synthetic spacer oligonucleotide
actaatcattaacggtgttaacactccgtccgac

SEQ ID NO: 1054 - DNA, 34 bp, Artificial Sequence
  Description of Artificial Sequence: Synthetic spacer oligonucleotide
acaaagtggtcaacccacggaccgctgctgccgg

SEQ ID NO: 1055 - DNA, 34 bp, Artificial Sequence
  Description of Artificial Sequence: Synthetic spacer oligonucleotide
acaacccatttcggatcgttcgggtcgctgatgc

SEQ ID NO: 1056 - DNA, 33 bp, Artificial Sequence
  Description of Artificial Sequence: Synthetic spacer oligonucleotide
acattatcgtgtgacgttcgtcgacccgtatac

SEQ ID NO: 1057 - DNA, 34 bp, Artificial Sequence
  Description of Artificial Sequence: Synthetic spacer oligonucleotide
actgcaggcgtcaacgttcgataatgaagccaat

SEQ ID NO: 1058 - DNA, 34 bp, Artificial Sequence
  Description of Artificial Sequence: Synthetic spacer oligonucleotide
acttctccgacttctttaatagttgagcggtggg

SEQ ID NO: 1059 - DNA, 34 bp, Artificial Sequence
  Description of Artificial Sequence: Synthetic spacer oligonucleotide
accactggccccgatatcgtttttggcgctatcg

SEQ ID NO: 1060 - DNA, 34 bp, Artificial Sequence
  Description of Artificial Sequence: Synthetic spacer oligonucleotide
acgtcgctgccgactcataaagtttttctctcat

SEQ ID NO: 1061 - DNA, 34 bp, Artificial Sequence
  Description of Artificial Sequence: Synthetic spacer oligonucleotide
actaatatgaaaaaaccgaaagataacgcaattc

SEQ ID NO: 1062 - DNA, 34 bp, Artificial Sequence
  Description of Artificial Sequence: Synthetic spacer oligonucleotide
acccaccaagccccttagcagcccactggagcac

SEQ ID NO: 1063 - DNA, 32 bp, Artificial Sequence
  Description of Artificial Sequence: Synthetic spacer oligonucleotide
gagataagattaaacgccccatcaccattagg

SEQ ID NO: 1064 - DNA, 34 bp, Artificial Sequence
  Description of Artificial Sequence: Synthetic spacer oligonucleotide
acgcgtgtcgagaaagaggctcaattgcgtgagg

SEQ ID NO: 1065 - DNA, 34 bp, Artificial Sequence
  Description of Artificial Sequence: Synthetic spacer oligonucleotide
acaggacggcagtaccgttaagggatatcgaact

SEQ ID NO: 1066 - DNA, 34 bp, Artificial Sequence
  Description of Artificial Sequence: Synthetic spacer oligonucleotide
actccgtgccgggttgattgaggctcccgatgtg

SEQ ID NO: 1067 - DNA, 34 bp, Artificial Sequence
  Description of Artificial Sequence: Synthetic spacer oligonucleotide
acagaccgagaccgagaccgggcagggcgtagcg

SEQ ID NO: 1068 - DNA, 33 bp, Artificial Sequence
  Description of Artificial Sequence: Synthetic spacer oligonucleotide
acaataccaggagtaacaacggatgagtcggtg

SEQ ID NO: 1069 - DNA, 34 bp, Artificial Sequence
  Description of Artificial Sequence: Synthetic spacer oligonucleotide
acattggtgtcccaagtcgcatatcggaaattgc

SEQ ID NO: 1070 - DNA, 34 bp, Artificial Sequence
  Description of Artificial Sequence: Synthetic spacer oligonucleotide
acacgccgctgagtggtggtagcggcggcccgga

SEQ ID NO: 1071 - DNA, 34 bp, Artificial Sequence
  Description of Artificial Sequence: Synthetic spacer oligonucleotide
acttatccgcgaggccagtgcggccgcgcgtggg

SEQ ID NO: 1072 - DNA, 33 bp, Artificial Sequence
  Description of Artificial Sequence: Synthetic spacer oligonucleotide
atttaataccggcgtctgtcggaactaattgtc

SEQ ID NO: 1073 - DNA, 34 bp, Artificial Sequence
  Description of Artificial Sequence: Synthetic spacer oligonucleotide
acgatgatgccaataaaatgcaaaaaacgtggcg

SEQ ID NO: 1074 - DNA, 34 bp, Artificial Sequence
  Description of Artificial Sequence: Synthetic spacer oligonucleotide
acgtcggcgctccgcacaaaagagacaggatctt

SEQ ID NO: 1075 - DNA, 34 bp, Artificial Sequence
  Description of Artificial Sequence: Synthetic spacer oligonucleotide
acgccattttcattactgaccgctatcggcatcc

SEQ ID NO: 1076 - DNA, 34 bp, Artificial Sequence
  Description of Artificial Sequence: Synthetic spacer oligonucleotide
acgtatttttgcgggatcaatgtcggctcgagca

SEQ ID NO: 1077 - DNA, 34 bp, Artificial Sequence
  Description of Artificial Sequence: Synthetic spacer oligonucleotide
accccgatcaccgaatccaattgcgccgtctgcg

SEQ ID NO: 1078 - DNA, 34 bp, Artificial Sequence
  Description of Artificial Sequence: Synthetic spacer oligonucleotide
acgctcgtcaatgttgccagcgtttcattactgg

SEQ ID NO: 1079 - DNA, 34 bp, Artificial Sequence
  Description of Artificial Sequence: Synthetic spacer oligonucleotide
acgccgtatcagcgatctgctgttagaacacgaa

SEQ ID NO: 1080 - DNA, 34 bp, Artificial Sequence
  Description of Artificial Sequence: Synthetic spacer oligonucleotide
actggggaaaaaccccgaccagttttgcgaggcg

SEQ ID NO: 1081 - DNA, 34 bp, Artificial Sequence
  Description of Artificial Sequence: Synthetic spacer oligonucleotide
acgctgattaatcgtgatcgccagcggtgcggcc

SEQ ID NO: 1082 - DNA, 32 bp, Artificial Sequence
  Description of Artificial Sequence: Synthetic spacer oligonucleotide
acaatgcagaaatgcaggcggtacagaccatg

SEQ ID NO: 1083 - DNA, 34 bp, Artificial Sequence
  Description of Artificial Sequence: Synthetic spacer oligonucleotide
acggttggagcggatggtatcccggttataaccc

SEQ ID NO: 1084 - DNA, 34 bp, Artificial Sequence
  Description of Artificial Sequence: Synthetic spacer oligonucleotide
acgaaaggtacggcaaagaacagtggctgactgg

SEQ ID NO: 1085 - DNA, 34 bp, Artificial Sequence
  Description of Artificial Sequence: Synthetic spacer oligonucleotide
accctgcgggatgtccaccgtaccgccgacagga

SEQ ID NO: 1086 - DNA, 34 bp, Artificial Sequence
  Description of Artificial Sequence: Synthetic spacer oligonucleotide
acggagcagctcgggtaagcagactgttgtcaat

SEQ ID NO: 1087 - DNA, 34 bp, Artificial Sequence
  Description of Artificial Sequence: Synthetic spacer oligonucleotide
acatggctggccgtcatcatgccgtggtacaccc

SEQ ID NO: 1088 - DNA, 34 bp, Artificial Sequence
  Description of Artificial Sequence: Synthetic spacer oligonucleotide
acattgattcaaccggaaacggactaattgagat

SEQ ID NO: 1089 - DNA, 34 bp, Artificial Sequence
  Description of Artificial Sequence: Synthetic spacer oligonucleotide
actcggtaaaatgctgcccgatactattaaacca

SEQ ID NO: 1090 - DNA, 33 bp, Artificial Sequence
  Description of Artificial Sequence: Synthetic spacer oligonucleotide
actgccagctctcttctaaatccatacattccc

SEQ ID NO: 1091 - DNA, 34 bp, Artificial Sequence
  Description of Artificial Sequence: Synthetic spacer oligonucleotide
acgcgatgctccagccgacgcattcgcttgatcg

SEQ ID NO: 1092 - DNA, 35 bp, Artificial Sequence
  Description of Artificial Sequence: Synthetic spacer oligonucleotide
acgtggatatttctaatgacaaaggacactcattg

SEQ ID NO: 1093 - DNA, 34 bp, Artificial Sequence
  Description of Artificial Sequence: Synthetic spacer oligonucleotide
acggtttcaatgaccacaggttttttgttcgatc

SEQ ID NO: 1094 - DNA, 34 bp, Artificial Sequence
  Description of Artificial Sequence: Synthetic spacer oligonucleotide
acgccggtagtcagcacatcattaaaatcacccg

SEQ ID NO: 1095 - DNA, 34 bp, Artificial Sequence
  Description of Artificial Sequence: Synthetic spacer oligonucleotide
acttcatggctgcctcatcagtaaatccagcgtc

SEQ ID NO: 1096 - DNA, 34 bp, Artificial Sequence
  Description of Artificial Sequence: Synthetic spacer oligonucleotide
acgcgcgcggtagagcgtatgcagaacggcgtta

SEQ ID NO: 1097 - DNA, 34 bp, Artificial Sequence
  Description of Artificial Sequence: Synthetic spacer oligonucleotide
acaggtatggtgtacccggtcagttctgtgatca

SEQ ID NO: 1098 - DNA, 32 bp, Artificial Sequence
  Description of Artificial Sequence: Synthetic spacer oligonucleotide
gcggcgggttccaaactggccaaagcgcagga

SEQ ID NO: 1099 - DNA, 32 bp, Artificial Sequence
  Description of Artificial Sequence: Synthetic spacer oligonucleotide
ggcaaggcgtttaaacgcttttttgatatcgg

SEQ ID NO: 1100 - DNA, 32 bp, Artificial Sequence
  Description of Artificial Sequence: Synthetic spacer oligonucleotide
taccaccctctgaagcacactgaggaaatgtg

SEQ ID NO: 1101 - DNA, 34 bp, Artificial Sequence
  Description of Artificial Sequence: Synthetic spacer oligonucleotide
acctacagccaggaatagccatttaaatttctgg

SEQ ID NO: 1102 - DNA, 34 bp, Artificial Sequence
  Description of Artificial Sequence: Synthetic spacer oligonucleotide
acgtgtaaccaaatgcgggggagtaaaaacggta

SEQ ID NO: 1103 - DNA, 34 bp, Artificial Sequence
  Description of Artificial Sequence: Synthetic spacer oligonucleotide
acgtcggcaagaacaatctcgcggccgcgaaaac

SEQ ID NO: 1104 - DNA, 34 bp, Artificial Sequence
  Description of Artificial Sequence: Synthetic spacer oligonucleotide
acaatttttgatagaaccaattcccctttcggta

SEQ ID NO: 1105 - DNA, 34 bp, Artificial Sequence
  Description of Artificial Sequence: Synthetic spacer oligonucleotide
acccgttggccaggccgggcagcaatttaaggca

SEQ ID NO: 1106 - DNA, 34 bp, Artificial Sequence
  Description of Artificial Sequence: Synthetic spacer oligonucleotide
atttttcagcccttgtcgactgcggaacgcccct

SEQ ID NO: 1107 - DNA, 34 bp, Artificial Sequence
  Description of Artificial Sequence: Synthetic spacer oligonucleotide
acgttacgttcggtaaatggaaagcggcgaatat

SEQ ID NO: 1108 - DNA, 34 bp, Artificial Sequence
  Description of Artificial Sequence: Synthetic spacer oligonucleotide
acccagaaagtgccggtagtgcctgatgaacgac

SEQ ID NO: 1109 - DNA, 34 bp, Artificial Sequence
  Description of Artificial Sequence: Synthetic spacer oligonucleotide
accgcgcccacttccgtaaaatacagataatcca

SEQ ID NO: 1110 - DNA, 34 bp, Artificial Sequence
  Description of Artificial Sequence: Synthetic spacer oligonucleotide
accgcgcccacttccgtaagatacagataatcca

SEQ ID NO: 1111 - DNA, 34 bp, Artificial Sequence
  Description of Artificial Sequence: Synthetic spacer oligonucleotide
acggtaatttctcatctaacagcctgtacgcctc

SEQ ID NO: 1112 - DNA, 34 bp, Artificial Sequence
  Description of Artificial Sequence: Synthetic spacer oligonucleotide
acgaatctaatgcaacagatgaataaacacgtaa

SEQ ID NO: 1113 - DNA, 34 bp, Artificial Sequence
  Description of Artificial Sequence: Synthetic spacer oligonucleotide
actctttatcgtcaatgcgaaattttccgcgacg

SEQ ID NO: 1114 - DNA, 34 bp, Artificial Sequence
  Description of Artificial Sequence: Synthetic spacer oligonucleotide
actcccattcaccaacaacaatatcgccctgcaa

SEQ ID NO: 1115 - DNA, 34 bp, Artificial Sequence
  Description of Artificial Sequence: Synthetic spacer oligonucleotide
accgttgcgtcaggttgatccagtgcgtcagcgg

SEQ ID NO: 1116 - DNA, 34 bp, Artificial Sequence
  Description of Artificial Sequence: Synthetic spacer oligonucleotide
actctcggtctcggtctcggtctcggtagtgacg

SEQ ID NO: 1117 - DNA, 52 bp, Artificial Sequence
  Description of Artificial Sequence: Synthetic spacer oligonucleotide
actctcggtctcggtctcggtctcggtctcggtctcggtctcggtagtgacg

SEQ ID NO: 1118 - DNA, 38 bp, Artificial Sequence
  Description of Artificial Sequence: Synthetic spacer oligonucleotide
tctcggtctcggtctcggtctcggtctcggtagtgacg

SEQ ID NO: 1119 - DNA, 34 bp, Artificial Sequence
  Description of Artificial Sequence: Synthetic spacer oligonucleotide
acacttccttcagtcttaacgataatccgcaacg

SEQ ID NO: 1120 - DNA, 34 bp, Artificial Sequence
  Description of Artificial Sequence: Synthetic spacer oligonucleotide
atttttcagcccttgccgactgcggaacgcccct

SEQ ID NO: 1121 - DNA, 34 bp, Artificial Sequence
  Description of Artificial Sequence: Synthetic spacer oligonucleotide
atttttcaacccttgccgactgcggaacgcccct

SEQ ID NO: 1122 - DNA, 34 bp, Artificial Sequence
  Description of Artificial Sequence: Synthetic spacer oligonucleotide
atttttcagaccttgtcgactgcggaacgcccct

SEQ ID NO: 1123 - DNA, 34 bp, Artificial Sequence
  Description of Artificial Sequence: Synthetic spacer oligonucleotide
acgcgaaatagtggggaaaaacccctggttaacc

SEQ ID NO: 1124 - DNA, 35 bp, Artificial Sequence
  Description of Artificial Sequence: Synthetic spacer oligonucleotide
acgcaaaatagcgatgagctggctacgcccactgg

SEQ ID NO: 1125 - DNA, 34 bp, Artificial Sequence
  Description of Artificial Sequence: Synthetic spacer oligonucleotide
acgaggggataggagttacgatccagcctggttg

SEQ ID NO: 1126 - DNA, 34 bp, Artificial Sequence
  Description of Artificial Sequence: Synthetic spacer oligonucleotide
acgtggttgcagaccaatcagcccgccagcggtt

SEQ ID NO: 1127 - DNA, 34 bp, Artificial Sequence
  Description of Artificial Sequence: Synthetic spacer oligonucleotide
accagcacgaaaaattatttactgtcgttgctca

SEQ ID NO: 1128 - DNA, 34 bp, Artificial Sequence
  Description of Artificial Sequence: Synthetic spacer oligonucleotide
acgtttattactgcttagttaattaatgggttgc

SEQ ID NO: 1129 - DNA, 34 bp, Artificial Sequence
  Description of Artificial Sequence: Synthetic spacer oligonucleotide
acaggcgaataatctctaatagtctcaattcgtt

SEQ ID NO: 1130 - DNA, 34 bp, Artificial Sequence
  Description of Artificial Sequence: Synthetic spacer oligonucleotide
actaaatctggcgtcgagacattcgaaatagtgc

SEQ ID NO: 1131 - DNA, 34 bp, Artificial Sequence
  Description of Artificial Sequence: Synthetic spacer oligonucleotide
acggcagcgggcgaggcaaacacattcggggcgt

SEQ ID NO: 1132 - DNA, 34 bp, Artificial Sequence
  Description of Artificial Sequence: Synthetic spacer oligonucleotide
acagccggcgcgagcctggagggttgaataatgg

SEQ ID NO: 1133 - DNA, 34 bp, Artificial Sequence
  Description of Artificial Sequence: Synthetic spacer oligonucleotide
actaggccttgataccatcgctcgcacctcgtca

SEQ ID NO: 1134 - DNA, 34 bp, Artificial Sequence
  Description of Artificial Sequence: Synthetic spacer oligonucleotide
accaatctcgcattcgttaccccacctgcatttt

SEQ ID NO: 1135 - DNA, 34 bp, Artificial Sequence
  Description of Artificial Sequence: Synthetic spacer oligonucleotide
actgtaacagtccgtcgttaatcagcgcggtggg

SEQ ID NO: 1136 - DNA, 34 bp, Artificial Sequence
  Description of Artificial Sequence: Synthetic spacer oligonucleotide
actaggccttgataccatcactcgcacctcgtca

SEQ ID NO: 1137 - DNA, 34 bp, Artificial Sequence
  Description of Artificial Sequence: Synthetic spacer oligonucleotide
actcttttgattttgctgcgatgttataaccaga

SEQ ID NO: 1138 - DNA, 34 bp, Artificial Sequence
  Description of Artificial Sequence: Synthetic spacer oligonucleotide
actatccacatatacccgcaatcatattcaagaa

SEQ ID NO: 1139 - DNA, 34 bp, Artificial Sequence
  Description of Artificial Sequence: Synthetic spacer oligonucleotide
acaatcactgcgggggtatttagcggaaacggct

SEQ ID NO: 1140 - DNA, 76 bp, Artificial Sequence
  Description of Artificial Sequence: Synthetic spacer oligonucleotide
acgatcgagtaacgtgcgctggaacgcgtcggcgcggggaacacaattaaagccgagggtggcaccgcgccttatt

SEQ ID NO: 1141 - DNA, 116 bp, Artificial Sequence
  Description of Artificial Sequence: Synthetic spacer oligonucleotide
gatcgagtaacgtgcgctggaacgcgtcggcgcggggaacacgatcgagtaacgtgcgctggaacgcgtcggcgcggggaacacaattaaagccgagggtggcaccgcgccttatt

SEQ ID NO: 1142 - DNA, 35 bp, Artificial Sequence
  Description of Artificial Sequence: Synthetic spacer oligonucleotide
acgcacctcgaaacggttttaaaacactaccgttt

SEQ ID NO: 1143 - DNA, 34 bp, Artificial Sequence
  Description of Artificial Sequence: Synthetic spacer oligonucleotide
actggaccgatggggccaacatcgccgaacgtgg

SEQ ID NO: 1144 - DNA, 34 bp, Artificial Sequence
  Description of Artificial Sequence: Synthetic spacer oligonucleotide
acatcttcatattgcgtgacgctgccgatgaacg

SEQ ID NO: 1145 - DNA, 34 bp, Artificial Sequence
  Description of Artificial Sequence: Synthetic spacer oligonucleotide
actataatatgaattaatttttgcgcataacctg

SEQ ID NO: 1146 - DNA, 34 bp, Artificial Sequence
  Description of Artificial Sequence: Synthetic spacer oligonucleotide
actgctcaataacgtcgtaaatagcgtaagctgg

SEQ ID NO: 1147 - DNA, 34 bp, Artificial Sequence
  Description of Artificial Sequence: Synthetic spacer oligonucleotide
actatttcgccttcggcactgacgtcaccgtcaa

SEQ ID NO: 1148 - skipped

SEQ ID NO: 1149 - DNA, 34 bp, Artificial Sequence
  Description of Artificial Sequence: Synthetic spacer oligonucleotide
acgtcgcgttcgttgccggtatagaccagcgtca

SEQ ID NO: 1150 - DNA, 34 bp, Artificial Sequence
  Description of Artificial Sequence: Synthetic spacer oligonucleotide
acatcgaatcgaaaccccagccacagaaataatt

SEQ ID NO: 1151 - DNA, 34 bp, Artificial Sequence
  Description of Artificial Sequence: Synthetic spacer oligonucleotide
acgctcatgtcaaacgccatcagcgttccggcat

SEQ ID NO: 1152 - DNA, 34 bp, Artificial Sequence
  Description of Artificial Sequence: Synthetic spacer oligonucleotide
acaatcgccagcctcggaaatattccatcctccg

SEQ ID NO: 1153 - DNA, 34 bp, Artificial Sequence
  Description of Artificial Sequence: Synthetic spacer oligonucleotide
acaggaactaaacagcctgaccgttgaggatctg

SEQ ID NO: 1154 - DNA, 34 bp, Artificial Sequence
  Description of Artificial Sequence: Synthetic spacer oligonucleotide
acaggaactaaacaacctgaccgttgaggatctg

SEQ ID NO: 1155 - DNA, 34 bp, Artificial Sequence
  Description of Artificial Sequence: Synthetic spacer oligonucleotide
acaccggacaaatcttttttttcctgttcctgtt

SEQ ID NO: 1156 - DNA, 34 bp, Artificial Sequence
  Description of Artificial Sequence: Synthetic spacer oligonucleotide
acgggcactatgaacggatcggcgctgatgccgg

SEQ ID NO: 1157 - DNA, 34 bp, Artificial Sequence
  Description of Artificial Sequence: Synthetic spacer oligonucleotide
acggtaaagccacaccattttttattgacctcgc

SEQ ID NO: 1158 - DNA, 34 bp, Artificial Sequence
  Description of Artificial Sequence: Synthetic spacer oligonucleotide
actgcccgttctgcctcttcgcactctcgatcaa

SEQ ID NO: 1159 - DNA, 34 bp, Artificial Sequence
  Description of Artificial Sequence: Synthetic spacer oligonucleotide
acgtggtggcctcaaataaattcgagcgctggag

SEQ ID NO: 1160 - DNA, 34 bp, Artificial Sequence
  Description of Artificial Sequence: Synthetic spacer oligonucleotide
actcgacgtggacgaggagttactcaaccgctgc

SEQ ID NO: 1161 - DNA, 34 bp, Artificial Sequence
  Description of Artificial Sequence: Synthetic spacer oligonucleotide
acagcgccacatggcccaccggcaccacccgatc

SEQ ID NO: 1162 - DNA, 34 bp, Artificial Sequence
  Description of Artificial Sequence: Synthetic spacer oligonucleotide
acaaatgaccaaatcagaaatcttcaccaaagcc

SEQ ID NO: 1163 - DNA, 34 bp, Artificial Sequence
  Description of Artificial Sequence: Synthetic spacer oligonucleotide
actaatggccacagtaagtcaaacggttctggaa

SEQ ID NO: 1164 - DNA, 34 bp, Artificial Sequence
  Description of Artificial Sequence: Synthetic spacer oligonucleotide
acgagtccgggggttatatagttatttaatgagc

SEQ ID NO: 1165 - DNA, 34 bp, Artificial Sequence
  Description of Artificial Sequence: Synthetic spacer oligonucleotide
acttgggcgtcggttttttcaggtttaggtccgg

SEQ ID NO: 1166 - DNA, 34 bp, Artificial Sequence
  Description of Artificial Sequence: Synthetic spacer oligonucleotide
actcaactgtcagttcgtcgttagccagtaattc

SEQ ID NO: 1167 - DNA, 34 bp, Artificial Sequence
  Description of Artificial Sequence: Synthetic spacer oligonucleotide
acctgaaaacgcatggaatccggtataaacagtc

SEQ ID NO: 1168 - DNA, 34 bp, Artificial Sequence
  Description of Artificial Sequence: Synthetic spacer oligonucleotide
acgatgtaactgatagcgaaatatattgggataa

SEQ ID NO: 1169 - DNA, 34 bp, Artificial Sequence
  Description of Artificial Sequence: Synthetic spacer oligonucleotide
actgcgtaatgggctacctgaacttcacatatcc

SEQ ID NO: 1170 - DNA, 34 bp, Artificial Sequence
  Description of Artificial Sequence: Synthetic spacer oligonucleotide
acgaaacgtaaacagggtaagatacaactctgca

SEQ ID NO: 1171 - DNA, 34 bp, Artificial Sequence
  Description of Artificial Sequence: Synthetic spacer oligonucleotide
actgtaaagggtggtctggaaggggatcggcaaa

SEQ ID NO: 1172 - DNA, 34 bp, Artificial Sequence
  Description of Artificial Sequence: Synthetic spacer oligonucleotide
actctttatcagctaaccatttccagaactcgtc

SEQ ID NO: 1173 - DNA, 34 bp, Artificial Sequence
  Description of Artificial Sequence: Synthetic spacer oligonucleotide
acctaggaggcgtaatgaatactacgtatcaaaa

SEQ ID NO: 1174 - DNA, 34 bp, Artificial Sequence
  Description of Artificial Sequence: Synthetic spacer oligonucleotide
acttgaggtgccgcttgccgttcttctgtttttt

SEQ ID NO: 1175 - DNA, 34 bp, Artificial Sequence
  Description of Artificial Sequence: Synthetic spacer oligonucleotide
atattaagcgcgcaaagtttgggttaattggaca

SEQ ID NO: 1176 - DNA, 34 bp, Artificial Sequence
  Description of Artificial Sequence: Synthetic spacer oligonucleotide
accgtattcgtcacacagccccgtccagaaatga

SEQ ID NO: 1177 - DNA, 34 bp, Artificial Sequence
  Description of Artificial Sequence: Synthetic spacer oligonucleotide
actaacgaactgaataaaatgtcagaaagtgacg

SEQ ID NO: 1178 - DNA, 35 bp, Artificial Sequence
  Description of Artificial Sequence: Synthetic spacer oligonucleotide
acgcagcttagcgacgaaattaaaaccgaactcac

SEQ ID NO: 1179 - DNA, 34 bp, Artificial Sequence
  Description of Artificial Sequence: Synthetic spacer oligonucleotide
actgccagtgactacagaagcgtcgctatcgggg

SEQ ID NO: 1180 - DNA, 34 bp, Artificial Sequence
  Description of Artificial Sequence: Synthetic spacer oligonucleotide
actgccagtgactacagaagcgtctctatcgggg

SEQ ID NO: 1181 - DNA, 34 bp, Artificial Sequence
  Description of Artificial Sequence: Synthetic spacer oligonucleotide
acaccgataaacaaccgcatagcctctttcgttt

SEQ ID NO: 1182 - DNA, 34 bp, Artificial Sequence
  Description of Artificial Sequence: Synthetic spacer oligonucleotide
acaccggcaaaaggtacagaaaaaagaggcgtcg

SEQ ID NO: 1183 - DNA, 34 bp, Artificial Sequence
  Description of Artificial Sequence: Synthetic spacer oligonucleotide
acgtcagcaatatccgaaatcctgaacccctggc

SEQ ID NO: 1184 - DNA, 34 bp, Artificial Sequence
  Description of Artificial Sequence: Synthetic spacer oligonucleotide
acatcaagggggccagcacctacggcaacccggt

SEQ ID NO: 1185 - DNA, 35 bp, Artificial Sequence
  Description of Artificial Sequence: Synthetic spacer oligonucleotide
acttcagtaattgaattaaggcgctccacgcgcac

SEQ ID NO: 1186 - DNA, 35 bp, Artificial Sequence
  Description of Artificial Sequence: Synthetic spacer oligonucleotide
acgcacgttcagcgaaacctaactaagctcgggga

SEQ ID NO: 1187 - DNA, 35 bp, Artificial Sequence
  Description of Artificial Sequence: Synthetic spacer oligonucleotide
acggctgcatcaaacccaaatttcgtcgtgctcaa

SEQ ID NO: 1188 - DNA, 34 bp, Artificial Sequence
  Description of Artificial Sequence: Synthetic spacer oligonucleotide
acgggaatatgatttcgcaatgggtaattttttg

SEQ ID NO: 1189 - DNA, 75 bp, Artificial Sequence
  Description of Artificial Sequence: Synthetic spacer oligonucleotide
actgtgctaaaaatatcgccagcattaacaaccacggtttatccccgccacctatagcaaatgttttttttaatg

SEQ ID NO: 1190 - DNA, 35 bp, Artificial Sequence
  Description of Artificial Sequence: Synthetic spacer oligonucleotide
acgccagtaaatagccgtttcaatgtggtttaaat

SEQ ID NO: 1191 - DNA, 34 bp, Artificial Sequence
  Description of Artificial Sequence: Synthetic spacer oligonucleotide
actgtcgtccaacaacacaaccagactgtggcca

SEQ ID NO: 1192 - DNA, 34 bp, Artificial Sequence
  Description of Artificial Sequence: Synthetic spacer oligonucleotide
acaccagatcgtgccccagttccagcaactgacg

SEQ ID NO: 1193 - DNA, 34 bp, Artificial Sequence
  Description of Artificial Sequence: Synthetic spacer oligonucleotide
actttttcagtgatcgcccgcccctcctcgacca

SEQ ID NO: 1194 - DNA, 34 bp, Artificial Sequence
  Description of Artificial Sequence: Synthetic spacer oligonucleotide
acacgctgccgcattctctcctgttgctgttgca

SEQ ID NO: 1195 - DNA, 34 bp, Artificial Sequence
  Description of Artificial Sequence: Synthetic spacer oligonucleotide
acttgccgtttaagtcaatccgctccgacctcgg

SEQ ID NO: 1196 - DNA, 33 bp, Artificial Sequence
  Description of Artificial Sequence: Synthetic spacer oligonucleotide
acctggttcagcgtaatacgcaaaatacagttg

SEQ ID NO: 1197 - DNA, 35 bp, Artificial Sequence
  Description of Artificial Sequence: Synthetic spacer oligonucleotide
acacttggcggaaaaattttaataaactgaataac

SEQ ID NO: 1198 - DNA, 34 bp, Artificial Sequence
  Description of Artificial Sequence: Synthetic spacer oligonucleotide
acgtaaatatccagatatatggacgccaattata

SEQ ID NO: 1199 - DNA, 34 bp, Artificial Sequence
  Description of Artificial Sequence: Synthetic spacer oligonucleotide
acgtaatccggtccttattggtatcgaaagtacc

SEQ ID NO: 1200 - DNA, 34 bp, Artificial Sequence
  Description of Artificial Sequence: Synthetic spacer oligonucleotide
actcttttgattttgctgcaatattccaccgtga

SEQ ID NO: 1201 - DNA, 34 bp, Artificial Sequence
  Description of Artificial Sequence: Synthetic spacer oligonucleotide
acccggacaacagtgacacctgtaaattctgcgc

SEQ ID NO: 1202 - DNA, 34 bp, Artificial Sequence
  Description of Artificial Sequence: Synthetic spacer oligonucleotide
acgataattttgtttttgatttgatggcttcggc

SEQ ID NO: 1203 - DNA, 34 bp, Artificial Sequence
  Description of Artificial Sequence: Synthetic spacer oligonucleotide
acttttgataggtactaatcccggtagtaatgcg

SEQ ID NO: 1204 - DNA, 34 bp, Artificial Sequence
  Description of Artificial Sequence: Synthetic spacer oligonucleotide
acccgtcaacgatacagaatacgggacgctgttg

SEQ ID NO: 1205 - DNA, 34 bp, Artificial Sequence
  Description of Artificial Sequence: Synthetic spacer oligonucleotide
actgggacgccgacaggatagaatctatatcagt

SEQ ID NO: 1206 - DNA, 34 bp, Artificial Sequence
  Description of Artificial Sequence: Synthetic spacer oligonucleotide
actatagcttatcgcgataaagtcaatgtgttta

SEQ ID NO: 1207 - DNA, 34 bp, Artificial Sequence
  Description of Artificial Sequence: Synthetic spacer oligonucleotide
actagtcgattggtccggagcagataaaccggca

SEQ ID NO: 1208 - DNA, 34 bp, Artificial Sequence
  Description of Artificial Sequence: Synthetic spacer oligonucleotide
actttgtccagttcggcgatgcggcgttctgcgg

SEQ ID NO: 1209 - DNA, 34 bp, Artificial Sequence
  Description of Artificial Sequence: Synthetic spacer oligonucleotide
acgctcggggaagtatcaaccagcagataacggt

SEQ ID NO: 1210 - DNA, 34 bp, Artificial Sequence
  Description of Artificial Sequence: Synthetic spacer oligonucleotide
acaagtggtggcgcacctaatggctatagagcgt

SEQ ID NO: 1211 - DNA, 34 bp, Artificial Sequence
  Description of Artificial Sequence: Synthetic spacer oligonucleotide
acgcgcttacgattttttcccactcaataacgcc

SEQ ID NO: 1212 - DNA, 34 bp, Artificial Sequence
  Description of Artificial Sequence: Synthetic spacer oligonucleotide
actctaccctatctaacccattagaataaaagga

SEQ ID NO: 1213 - DNA, 34 bp, Artificial Sequence
  Description of Artificial Sequence: Synthetic spacer oligonucleotide
actaaatctttatgaagctgacgatggtcaacct

SEQ ID NO: 1214 - DNA, 34 bp, Artificial Sequence
  Description of Artificial Sequence: Synthetic spacer oligonucleotide
acctcacaacgtcgctattgaagtaaacacggcg

SEQ ID NO: 1215 - DNA, 34 bp, Artificial Sequence
  Description of Artificial Sequence: Synthetic spacer oligonucleotide
actaatatctgcgtgatgtggtcattgatgtggt

SEQ ID NO: 1216 - DNA, 34 bp, Artificial Sequence
  Description of Artificial Sequence: Synthetic spacer oligonucleotide
acaccaatatccagcgttctggttctttccacgg

SEQ ID NO: 1217 - DNA, 34 bp, Artificial Sequence
  Description of Artificial Sequence: Synthetic spacer oligonucleotide
acggtcaaaaataataccgcgcatgttctgaagg

SEQ ID NO: 1218 - DNA, 34 bp, Artificial Sequence
  Description of Artificial Sequence: Synthetic spacer oligonucleotide
acggggatatgggcacttggacgttttcccgctg

SEQ ID NO: 1219 - DNA, 34 bp, Artificial Sequence
  Description of Artificial Sequence: Synthetic spacer oligonucleotide
actcagcgtcgagcggggggacggcagcgtctgc

SEQ ID NO: 1220 - DNA, 34 bp, Artificial Sequence
  Description of Artificial Sequence: Synthetic spacer oligonucleotide
actggcgctggataaccgccctgacgagttggga

SEQ ID NO: 1221 - DNA, 34 bp, Artificial Sequence
  Description of Artificial Sequence: Synthetic spacer oligonucleotide
acttctcggcgcggcgcaatatcccggcgcacgc

SEQ ID NO: 1222 - DNA, 35 bp, Artificial Sequence
  Description of Artificial Sequence: Synthetic spacer oligonucleotide
acataaacgtattaaataaatcgaggtccagcccc

SEQ ID NO: 1223 - DNA, 34 bp, Artificial Sequence
  Description of Artificial Sequence: Synthetic spacer oligonucleotide
acataaagcgatcaagcgaatgcgtcggctggag

SEQ ID NO: 1224 - DNA, 34 bp, Artificial Sequence
  Description of Artificial Sequence: Synthetic spacer oligonucleotide
acattaacaggcggcatttttccagctggcggcg

SEQ ID NO: 1225 - DNA, 34 bp, Artificial Sequence
  Description of Artificial Sequence: Synthetic spacer oligonucleotide
acttgatgagtggacgaaaatttataaattatcg

SEQ ID NO: 1226 - DNA, 34 bp, Artificial Sequence
  Description of Artificial Sequence: Synthetic spacer oligonucleotide
actgcgaaatagtcacgtgagcaacgccgacaag

SEQ ID NO: 1227 - DNA, 34 bp, Artificial Sequence
  Description of Artificial Sequence: Synthetic spacer oligonucleotide
acttacgtactccggggaagtcgttagagagctg

SEQ ID NO: 1228 - DNA, 34 bp, Artificial Sequence
  Description of Artificial Sequence: Synthetic spacer oligonucleotide
acagaaaattatcactgacgagtgacaataactc

SEQ ID NO: 1229 - DNA, 32 bp, Artificial Sequence
  Description of Artificial Sequence: Synthetic spacer oligonucleotide
acgaggactctttaacagacgcccgcgtaacc

SEQ ID NO: 1230 - DNA, 34 bp, Artificial Sequence
  Description of Artificial Sequence: Synthetic spacer oligonucleotide
acgcatcggtggcgctggccagttcaaaaatacg

SEQ ID NO: 1231 - DNA, 34 bp, Artificial Sequence
  Description of Artificial Sequence: Synthetic spacer oligonucleotide
acctcaaacgaacgcagtatttgatcggatgttt

SEQ ID NO: 1232 - DNA, 34 bp, Artificial Sequence
  Description of Artificial Sequence: Synthetic spacer oligonucleotide
acggaggtgatccgggatttaaacaaaatgatta

SEQ ID NO: 1233 - DNA, 34 bp, Artificial Sequence
  Description of Artificial Sequence: Synthetic spacer oligonucleotide
acggtttacagacctcaataaaaagacggcaggc

SEQ ID NO: 1234 - DNA, 34 bp, Artificial Sequence
  Description of Artificial Sequence: Synthetic spacer oligonucleotide
acgtcagcgccggcgattgggccgccgattttgt

SEQ ID NO: 1235 - DNA, 34 bp, Artificial Sequence
  Description of Artificial Sequence: Synthetic spacer oligonucleotide
acaatgcaatttcctgactcccctaacctcaagg

SEQ ID NO: 1236 - DNA, 34 bp, Artificial Sequence
  Description of Artificial Sequence: Synthetic spacer oligonucleotide
acaagtaccggcaagtgtggtagcgaaggttatg

SEQ ID NO: 1237 - DNA, 34 bp, Artificial Sequence
  Description of Artificial Sequence: Synthetic spacer oligonucleotide
acgcgcttgatctcccgttatctaagggccaatc

SEQ ID NO: 1238 - DNA, 34 bp, Artificial Sequence
  Description of Artificial Sequence: Synthetic spacer oligonucleotide
actccggcggcagtacgggaggcatctgcattcg

SEQ ID NO: 1239 - DNA, 34 bp, Artificial Sequence
  Description of Artificial Sequence: Synthetic spacer oligonucleotide
acctttcatcagaatgcctctgggaaaccccggc

SEQ ID NO: 1240 - DNA, 34 bp, Artificial Sequence
  Description of Artificial Sequence: Synthetic spacer oligonucleotide
acagtgccgatgcgcggtatctggggaatttcgc

SEQ ID NO: 1241 - DNA, 34 bp, Artificial Sequence
  Description of Artificial Sequence: Synthetic spacer oligonucleotide
actgccaggcgtggggttatgacaatgctgaggc

SEQ ID NO: 1242 - DNA, 34 bp, Artificial Sequence
  Description of Artificial Sequence: Synthetic spacer oligonucleotide
acaacaatcaggttagttcgaatagccagcaacg

SEQ ID NO: 1243 - DNA, 34 bp, Artificial Sequence
  Description of Artificial Sequence: Synthetic spacer oligonucleotide
acgggttcgttagcgggatctggttgctgcgcca

SEQ ID NO: 1244 - DNA, 34 bp, Artificial Sequence
  Description of Artificial Sequence: Synthetic spacer oligonucleotide
acttcttataaaatcaataggttagctacatagc

SEQ ID NO: 1245 - DNA, 34 bp, Artificial Sequence
  Description of Artificial Sequence: Synthetic spacer oligonucleotide
acagtgccgatgcgcggtatctggggagttttgc

SEQ ID NO: 1246 - DNA, 34 bp, Artificial Sequence
  Description of Artificial Sequence: Synthetic spacer oligonucleotide
acataaaggtcggggacgatattgttacctggtg

SEQ ID NO: 1247 - DNA, 34 bp, Artificial Sequence
  Description of Artificial Sequence: Synthetic spacer oligonucleotide
acggtggaatcgcgcaaaactttgtttgtttccg

SEQ ID NO: 1248 - DNA, 34 bp, Artificial Sequence
  Description of Artificial Sequence: Synthetic spacer oligonucleotide
acgggtactgacaatagtacaaataaaaaaaacg

SEQ ID NO: 1249 - DNA, 34 bp, Artificial Sequence
  Description of Artificial Sequence: Synthetic spacer oligonucleotide
actcgaccaaaccaaagtgtgagaatcctgtata

SEQ ID NO: 1250 - DNA, 34 bp, Artificial Sequence
  Description of Artificial Sequence: Synthetic spacer oligonucleotide
acggttttggctatctgagcggcgtccgccgccg

SEQ ID NO: 1251 - DNA, 34 bp, Artificial Sequence
  Description of Artificial Sequence: Synthetic spacer oligonucleotide
actgacgctggacgaggcgagttctttccccgga

SEQ ID NO: 1252 - DNA, 34 bp, Artificial Sequence
  Description of Artificial Sequence: Synthetic spacer oligonucleotide
acatcataacggttttttacatataagaagttgc

SEQ ID NO: 1253 - DNA, 34 bp, Artificial Sequence
  Description of Artificial Sequence: Synthetic spacer oligonucleotide
actccacgatgccggcaagctcccggtcgagccg

SEQ ID NO: 1254 - DNA, 34 bp, Artificial Sequence
  Description of Artificial Sequence: Synthetic spacer oligonucleotide
acggacagcaacccgtgtcggatatcagacagat

SEQ ID NO: 1255 - DNA, 34 bp, Artificial Sequence
  Description of Artificial Sequence: Synthetic spacer oligonucleotide
acacgcgaatcgccaatcgccgccgcgtgaattg

SEQ ID NO: 1256 - DNA, 34 bp, Artificial Sequence
  Description of Artificial Sequence: Synthetic spacer oligonucleotide
acccacgatgtatgccgaccgtgatttttaccgc

SEQ ID NO: 1257 - DNA, 34 bp, Artificial Sequence
  Description of Artificial Sequence: Synthetic spacer oligonucleotide
acagatacgcctttacgtcgccctctttggcgcg

SEQ ID NO: 1258 - DNA, 34 bp, Artificial Sequence
  Description of Artificial Sequence: Synthetic spacer oligonucleotide
acattaaaaaagattaatgttggttatagtttta

SEQ ID NO: 1259 - DNA, 34 bp, Artificial Sequence
  Description of Artificial Sequence: Synthetic spacer oligonucleotide
actaaaacaccggttgcgcaacctccgcggggat

SEQ ID NO: 1260 - DNA, 34 bp, Artificial Sequence
  Description of Artificial Sequence: Synthetic spacer oligonucleotide
actgctacacgcaaaaattccagtcgttggcgca

SEQ ID NO: 1261 - DNA, 34 bp, Artificial Sequence
  Description of Artificial Sequence: Synthetic spacer oligonucleotide
acgctgcatcaaaccaaaattttgtcgtgctcaa

SEQ ID NO: 1262 - DNA, 34 bp, Artificial Sequence
  Description of Artificial Sequence: Synthetic spacer oligonucleotide
acggtgtgccaatggacaatacaaagcattttcg

SEQ ID NO: 1263 - DNA, 35 bp, Artificial Sequence
  Description of Artificial Sequence: Synthetic spacer oligonucleotide
acttcaccctcgtagtagttgaggcgggatatcaa

SEQ ID NO: 1264 - DNA, 34 bp, Artificial Sequence
  Description of Artificial Sequence: Synthetic spacer oligonucleotide
acgatggtcattgtgcgtgatgatgtattacgcc

SEQ ID NO: 1265 - DNA, 34 bp, Artificial Sequence
  Description of Artificial Sequence: Synthetic spacer oligonucleotide
acggatgacagcgtcacaattacaggggagacgc

SEQ ID NO: 1266 - DNA, 34 bp, Artificial Sequence
  Description of Artificial Sequence: Synthetic spacer oligonucleotide
actatggcgcagcaattcaaagagcaacacaagg

SEQ ID NO: 1267 - DNA, 34 bp, Artificial Sequence
  Description of Artificial Sequence: Synthetic spacer oligonucleotide
acttcgtcagggagaaaatcgcggggtcccgccg

SEQ ID NO: 1268 - DNA, 34 bp, Artificial Sequence
  Description of Artificial Sequence: Synthetic spacer oligonucleotide
acccagtctgtctatgtcgtcactagtacgtgac

SEQ ID NO: 1269 - DNA, 34 bp, Artificial Sequence
  Description of Artificial Sequence: Synthetic spacer oligonucleotide
actgatttaccaatatattgttgtcttttccaag

SEQ ID NO: 1270 - DNA, 34 bp, Artificial Sequence
  Description of Artificial Sequence: Synthetic spacer oligonucleotide
accctgtcaattactggctcaaaaggtgcatgtg

SEQ ID NO: 1271 - DNA, 34 bp, Artificial Sequence
  Description of Artificial Sequence: Synthetic spacer oligonucleotide
accgtaagcgccagcacgtgcacaatagagccgc

SEQ ID NO: 1272 - DNA, 36 bp, Artificial Sequence
  Description of Artificial Sequence: Synthetic spacer oligonucleotide
acactaaacgggagagcgcgccacgctgatatggcg

SEQ ID NO: 1273 - DNA, 34 bp, Artificial Sequence
  Description of Artificial Sequence: Synthetic spacer oligonucleotide
accagtacgacgatctgcgcgaacaatatcagcg

SEQ ID NO: 1274 - DNA, 34 bp, Artificial Sequence
  Description of Artificial Sequence: Synthetic spacer oligonucleotide
acacttgcccgtccgtttcctcccacggaagttt

SEQ ID NO: 1275 - DNA, 34 bp, Artificial Sequence
  Description of Artificial Sequence: Synthetic spacer oligonucleotide
acctgactgtatagccgatcacttttgttgatgc

SEQ ID NO: 1276 - DNA, 34 bp, Artificial Sequence
  Description of Artificial Sequence: Synthetic spacer oligonucleotide
accgtccagatggggtgattatgacgagtcagag

SEQ ID NO: 1277 - DNA, 34 bp, Artificial Sequence
  Description of Artificial Sequence: Synthetic spacer oligonucleotide
actggactcgcgtttatgcggcggggtgtccagc

SEQ ID NO: 1278 - DNA, 34 bp, Artificial Sequence
  Description of Artificial Sequence: Synthetic spacer oligonucleotide
acatgtactaccacggccgccacgtcgcccggac

SEQ ID NO: 1279 - DNA, 34 bp, Artificial Sequence
  Description of Artificial Sequence: Synthetic spacer oligonucleotide
actctgaaatccgctacgatggcggagaagcccc

SEQ ID NO: 1280 - DNA, 34 bp, Artificial Sequence
  Description of Artificial Sequence: Synthetic spacer oligonucleotide
actggaggcgctcacacggtaaacgcccggatag

SEQ ID NO: 1281 - DNA, 34 bp, Artificial Sequence
  Description of Artificial Sequence: Synthetic spacer oligonucleotide
actggtcagcagccagccccgcgttcggggcgta

SEQ ID NO: 1282 - DNA, 34 bp, Artificial Sequence
  Description of Artificial Sequence: Synthetic spacer oligonucleotide
acgtcagtaatactgttgtcagtaggtgcatgtg

SEQ ID NO: 1283 - DNA, 34 bp, Artificial Sequence
  Description of Artificial Sequence: Synthetic spacer oligonucleotide
accaactggtctttgtaggcggtgagttcatttt

SEQ ID NO: 1284 - DNA, 34 bp, Artificial Sequence
  Description of Artificial Sequence: Synthetic spacer oligonucleotide
acataaacagcgcccagatgatcgcccagttgcc

SEQ ID NO: 1285 - DNA, 34 bp, Artificial Sequence
  Description of Artificial Sequence: Synthetic spacer oligonucleotide
acatttccagcgttatgcggctggcccagcgcgg

SEQ ID NO: 1286 - DNA, 34 bp, Artificial Sequence
  Description of Artificial Sequence: Synthetic spacer oligonucleotide
accggcacagatggaagctcgcaaacgtgagtta

SEQ ID NO: 1287 - DNA, 34 bp, Artificial Sequence
  Description of Artificial Sequence: Synthetic spacer oligonucleotide
acggttttgtggcgagagaggtgagtgcaacatt

SEQ ID NO: 1288 - DNA, 34 bp, Artificial Sequence
  Description of Artificial Sequence: Synthetic spacer oligonucleotide
acggtaaacgagccgccaggctgaaagaagccta

SEQ ID NO: 1289 - DNA, 34 bp, Artificial Sequence
  Description of Artificial Sequence: Synthetic spacer oligonucleotide
acatcagtcacaatcttttgcggctcaacctcag

SEQ ID NO: 1290 - DNA, 34 bp, Artificial Sequence
  Description of Artificial Sequence: Synthetic spacer oligonucleotide
acctcttcaggggtggatacgctgtattgtgtct

SEQ ID NO: 1291 - DNA, 34 bp, Artificial Sequence
  Description of Artificial Sequence: Synthetic spacer oligonucleotide
acctgttccagtacgtccaccagctccgacgaaa

SEQ ID NO: 1292 - DNA, 32 bp, Artificial Sequence
  Description of Artificial Sequence: Synthetic spacer oligonucleotide
gggggatcggggtgtgggggtaggaatagcgc

SEQ ID NO: 1293 - DNA, 33 bp, Artificial Sequence
  Description of Artificial Sequence: Synthetic spacer oligonucleotide
gtcagcgccagtagtctgcgctgcattcgtcgt

SEQ ID NO: 1294 - DNA, 34 bp, Artificial Sequence
  Description of Artificial Sequence: Synthetic spacer oligonucleotide
acgcgaccatcattgtatcgtaagcgcggattac

SEQ ID NO: 1295 - DNA, 32 bp, Artificial Sequence
  Description of Artificial Sequence: Synthetic spacer oligonucleotide
gtcagtaatactgttgtcagtatacgtattgg

SEQ ID NO: 1296 - DNA, 34 bp, Artificial Sequence
  Description of Artificial Sequence: Synthetic spacer oligonucleotide
acatctgtcagcaatccaaacatgatacaatttt

SEQ ID NO: 1297 - DNA, 34 bp, Artificial Sequence
  Description of Artificial Sequence: Synthetic spacer oligonucleotide
actaccgccgggtatgtacgacgataaggcgcgg

SEQ ID NO: 1298 - DNA, 34 bp, Artificial Sequence
  Description of Artificial Sequence: Synthetic spacer oligonucleotide
acgtcgtgcagccgcaggatgtgctggaagaacg

SEQ ID NO: 1299 - DNA, 34 bp, Artificial Sequence
  Description of Artificial Sequence: Synthetic spacer oligonucleotide
acgcgtttgccgggctggaagatgatcagtacaa

SEQ ID NO: 1300 - DNA, 34 bp, Artificial Sequence
  Description of Artificial Sequence: Synthetic spacer oligonucleotide
actacgtaacgtttaagcgtggaaaggcgcggat

SEQ ID NO: 1301 - DNA, 34 bp, Artificial Sequence
  Description of Artificial Sequence: Synthetic spacer oligonucleotide
acttcgaaaatgacccgcagcgcccgttttttcg

SEQ ID NO: 1302 - DNA, 34 bp, Artificial Sequence
  Description of Artificial Sequence: Synthetic spacer oligonucleotide
acgaagggccggttaatatgtgttcctactcacc

SEQ ID NO: 1303 - skipped

SEQ ID NO: 1304 - DNA, 34 bp, Artificial Sequence
  Description of Artificial Sequence: Synthetic spacer oligonucleotide
acggtttttcgtcgaaatcaatttgccactcgtg

SEQ ID NO: 1305 - DNA, 34 bp, Artificial Sequence
  Description of Artificial Sequence: Synthetic spacer oligonucleotide
acgcaatggcagcaacaaaaagcgacaatctgaa

SEQ ID NO: 1306 - DNA, 34 bp, Artificial Sequence
  Description of Artificial Sequence: Synthetic spacer oligonucleotide
acccacgctggatcagttccctgattgtggtcgg

SEQ ID NO: 1307 - DNA, 34 bp, Artificial Sequence
  Description of Artificial Sequence: Synthetic spacer oligonucleotide
acaggcgtctttatggcgcacagtaccagcctgg

SEQ ID NO: 1308 - DNA, 34 bp, Artificial Sequence
  Description of Artificial Sequence: Synthetic spacer oligonucleotide
acgctaataacgtcacgcgctgccaggccgtcaa

SEQ ID NO: 1309 - DNA, 34 bp, Artificial Sequence
  Description of Artificial Sequence: Synthetic spacer oligonucleotide
acgacggatattgcccgactggcaggcctgtccg

SEQ ID NO: 1310 - DNA, 34 bp, Artificial Sequence
  Description of Artificial Sequence: Synthetic spacer oligonucleotide
acaataacccgttcattgagggaatggttgttcc

SEQ ID NO: 1311 - DNA, 34 bp, Artificial Sequence
  Description of Artificial Sequence: Synthetic spacer oligonucleotide
acttccatttgtcccgttttagaattaaacaaaa

SEQ ID NO: 1312 - DNA, 34 bp, Artificial Sequence
  Description of Artificial Sequence: Synthetic spacer oligonucleotide
acccctgacgcctgatcggcgtaggattcgatat

SEQ ID NO: 1313 - DNA, 34 bp, Artificial Sequence
  Description of Artificial Sequence: Synthetic spacer oligonucleotide
actgaaaaagcaatgggcgccgtatgtttccgta

SEQ ID NO: 1314 - DNA, 34 bp, Artificial Sequence
  Description of Artificial Sequence: Synthetic spacer oligonucleotide
acatttaatcaattttgtgaacagttcgcgaaca

SEQ ID NO: 1315 - DNA, 34 bp, Artificial Sequence
  Description of Artificial Sequence: Synthetic spacer oligonucleotide
acgcgccctcgttctgctgggcatacagtcggat

SEQ ID NO: 1316 - DNA, 34 bp, Artificial Sequence
  Description of Artificial Sequence: Synthetic spacer oligonucleotide
actgatccgggatttaaacaaaatgattaattaa

SEQ ID NO: 1317 - DNA, 34 bp, Artificial Sequence
  Description of Artificial Sequence: Synthetic spacer oligonucleotide
acccattgcgccgtcggtctggatttttgccgga

SEQ ID NO: 1318 - DNA, 34 bp, Artificial Sequence
  Description of Artificial Sequence: Synthetic spacer oligonucleotide
acgatccgttacagggtctgtccggatttaaaaa

SEQ ID NO: 1319 - DNA, 34 bp, Artificial Sequence
  Description of Artificial Sequence: Synthetic spacer oligonucleotide
acaccgataatagtattactgacgccacaaacga

SEQ ID NO: 1320 - DNA, 34 bp, Artificial Sequence
  Description of Artificial Sequence: Synthetic spacer oligonucleotide
acaatgacagcaccgcgtcaaactgcaattgcgc

SEQ ID NO: 1321 - DNA, 34 bp, Artificial Sequence
  Description of Artificial Sequence: Synthetic spacer oligonucleotide
acctgtggataaccctacaaattttagtgacctg

SEQ ID NO: 1322 - DNA, 34 bp, Artificial Sequence
  Description of Artificial Sequence: Synthetic spacer oligonucleotide
acaagtggttgctgtcgttgacggtgtcgcggta

SEQ ID NO: 1323 - DNA, 34 bp, Artificial Sequence
  Description of Artificial Sequence: Synthetic spacer oligonucleotide
acacgagtgtcaaggaacgaattagttgataagg

SEQ ID NO: 1324 - DNA, 34 bp, Artificial Sequence
  Description of Artificial Sequence: Synthetic spacer oligonucleotide
accccgccagaacatcaacgccattaataatgcg

SEQ ID NO: 1325 - DNA, 34 bp, Artificial Sequence
  Description of Artificial Sequence: Synthetic spacer oligonucleotide
actggtcatcatcgtttcctgggggcaaaggccg

SEQ ID NO: 1326 - DNA, 20 bp, Artificial Sequence
  Description of Artificial Sequence: Synthetic primer
gtrgtrcggataatgctgcc

SEQ ID NO: 1327 - DNA, 23 bp, Artificial Sequence
  Description of Artificial Sequence: Synthetic primer
cgtattccggtagatbtdgatgg

SEQ ID NO: 1328 - DNA, 22 bp, Artificial Sequence
  Description of Artificial Sequence: Synthetic primer
ctattttggrctrccgacratg

SEQ ID NO: 1329 - DNA, 21 bp, Artificial Sequence
  Description of Artificial Sequence: Synthetic primer
gcaatcggagcgattgatggc

SEQ ID NO: 1330 - DNA, 25 bp, Artificial Sequence
  Description of Artificial Sequence: Synthetic primer
gagcaatacyytratcgttaacgcc

SEQ ID NO: 1331 - DNA, 25 bp, Artificial Sequence
  Description of Artificial Sequence: Synthetic primer
gttgcdatakgtygrtrgratgtrg

SEQ ID NO: 1332 - DNA, 21 bp, Artificial Sequence
  Description of Artificial Sequence: Synthetic primer
ctggcggctgtctatgcaaac

SEQ ID NO: 1333 - DNA, 32 bp, Artificial Sequence
  Description of Artificial Sequence: Synthetic spacer oligonucleotide
aatctggtactcggcaagcgccgtttcgatac

SEQ ID NO: 1334 - DNA, 32 bp, Artificial Sequence
  Description of Artificial Sequence: Synthetic spacer oligonucleotide
gctagcctgctccgcattaaccgcctttaatg

SEQ ID NO: 1335 - DNA, 32 bp, Artificial Sequence
  Description of Artificial Sequence: Synthetic spacer oligonucleotide
atgaaatgcaggaaggtgaatatctcctcagg

SEQ ID NO: 1336 - DNA, 32 bp, Artificial Sequence
  Description of Artificial Sequence: Synthetic spacer oligonucleotide
ccccccgcactaaatcaccggaattacgattg

SEQ ID NO: 1337 - DNA, 32 bp, Artificial Sequence
  Description of Artificial Sequence: Synthetic spacer oligonucleotide
tcggtaaccggactcaaaaagattatttacag

SEQ ID NO: 1338 - DNA, 32 bp, Artificial Sequence
  Description of Artificial Sequence: Synthetic spacer oligonucleotide
aacggcttccgtttgaacggacagccggcgca

SEQ ID NO: 1339 - DNA, 32 bp, Artificial Sequence
  Description of Artificial Sequence: Synthetic spacer oligonucleotide
ttcaatgtccgccagttgccagttggcgtgac

SEQ ID NO: 1340 - DNA, 32 bp, Artificial Sequence
  Description of Artificial Sequence: Synthetic spacer oligonucleotide
tatctgtgatgactttgttacctgcataatcc

SEQ ID NO: 1341 - DNA, 32 bp, Artificial Sequence
  Description of Artificial Sequence: Synthetic spacer oligonucleotide
gaacttacacgacagcgcaatgggacgcaggc

SEQ ID NO: 1342 - DNA, 32 bp, Artificial Sequence
  Description of Artificial Sequence: Synthetic spacer oligonucleotide
ttacgtctacactccacgttaccgttctgtgg

SEQ ID NO: 1343 - DNA, 32 bp, Artificial Sequence
  Description of Artificial Sequence: Synthetic spacer oligonucleotide
cctaacacctatgaaggttttgaccagatagc

SEQ ID NO: 1344 - DNA, 32 bp, Artificial Sequence
  Description of Artificial Sequence: Synthetic spacer oligonucleotide
acaacacgacggccttcccggtaatatttgac

SEQ ID NO: 1345 - DNA, 32 bp, Artificial Sequence
  Description of Artificial Sequence: Synthetic spacer oligonucleotide
ttaagtgcggcattaacatcagcatgaaaccg

SEQ ID NO: 1346 - DNA, 32 bp, Artificial Sequence
  Description of Artificial Sequence: Synthetic spacer oligonucleotide
gtattcacgaatacgttcaggatcgagcctga

SEQ ID NO: 1347 - DNA, 32 bp, Artificial Sequence
  Description of Artificial Sequence: Synthetic spacer oligonucleotide
taacaaggcgcttcagctagggcttgatatta

SEQ ID NO: 1348 - DNA, 32 bp, Artificial Sequence
  Description of Artificial Sequence: Synthetic spacer oligonucleotide
aagcagtttcgccgccagttgaagaccggaac

SEQ ID NO: 1349 - DNA, 32 bp, Artificial Sequence
  Description of Artificial Sequence: Synthetic spacer oligonucleotide
gggtttatgcgagtttcccagcccctgatgct

SEQ ID NO: 1350 - DNA, 32 bp, Artificial Sequence
  Description of Artificial Sequence: Synthetic spacer oligonucleotide
gtgcgggacctcaatcgacacgccagacgaga

SEQ ID NO: 1351 - DNA, 32 bp, Artificial Sequence
  Description of Artificial Sequence: Synthetic spacer oligonucleotide
tgtttgataaatactactgattaaccccgcat

SEQ ID NO: 1352 - DNA, 32 bp, Artificial Sequence
  Description of Artificial Sequence: Synthetic spacer oligonucleotide
gccggtttcagcgttccagatcaccgtgtcgc

SEQ ID NO: 1353 - DNA, 32 bp, Artificial Sequence
  Description of Artificial Sequence: Synthetic spacer oligonucleotide
acggacaatcacatcctttccgaacatggcgg

SEQ ID NO: 1354 - DNA, 32 bp, Artificial Sequence
  Description of Artificial Sequence: Synthetic spacer oligonucleotide
gcgaatccgcgcggcgtaagtgagcgaagttg

SEQ ID NO: 1355 - DNA, 32 bp, Artificial Sequence
  Description of Artificial Sequence: Synthetic spacer oligonucleotide
agaccgggcagggcgtagcgcttgaaaccatg

SEQ ID NO: 1356 - DNA, 31 bp, Artificial Sequence
  Description of Artificial Sequence: Synthetic spacer oligonucleotide
acatatgaataggcatagccgaatgccgggg

SEQ ID NO: 1357 - DNA, 32 bp, Artificial Sequence
  Description of Artificial Sequence: Synthetic spacer oligonucleotide
gtgcgtagtagcgctgcaccttggctgacacg

SEQ ID NO: 1358 - DNA, 32 bp, Artificial Sequence
  Description of Artificial Sequence: Synthetic spacer oligonucleotide
tgcaggcgggcaatgtgctcttcaccgacgcc

SEQ ID NO: 1359 - DNA, 32 bp, Artificial Sequence
  Description of Artificial Sequence: Synthetic spacer oligonucleotide
tggatctcgcgggccgggtggcggctattcgc

SEQ ID NO: 1360 - DNA, 32 bp, Artificial Sequence
  Description of Artificial Sequence: Synthetic spacer oligonucleotide
gataaaatcttattcagcaaagataaaggcga

SEQ ID NO: 1361 - DNA, 32 bp, Artificial Sequence
  Description of Artificial Sequence: Synthetic spacer oligonucleotide
cgatatgtccgccgacgataaggttacgcagc

SEQ ID NO: 1362 - DNA, 32 bp, Artificial Sequence
  Description of Artificial Sequence: Synthetic spacer oligonucleotide
ttatcgagcagtatcgctacatgatcgaactg

SEQ ID NO: 1363 - DNA, 32 bp, Artificial Sequence
  Description of Artificial Sequence: Synthetic spacer oligonucleotide
gctgtcatctctctcccattgggaaacggaaa

SEQ ID NO: 1364 - DNA, 32 bp, Artificial Sequence
  Description of Artificial Sequence: Synthetic spacer oligonucleotide
gtcgcgtggcagcgtaccgcggggcgttgggg

SEQ ID NO: 1365 - DNA, 32 bp, Artificial Sequence
  Description of Artificial Sequence: Synthetic spacer oligonucleotide
ttttgaaactggcaccgaatcagttgatggtg

SEQ ID NO: 1366 - DNA, 32 bp, Artificial Sequence
  Description of Artificial Sequence: Synthetic spacer oligonucleotide
tcataaaccagcgctttgccagagtgtccgtg

SEQ ID NO: 1367 - DNA, 32 bp, Artificial Sequence
  Description of Artificial Sequence: Synthetic spacer oligonucleotide
ggacggaatactctgccgatacttgaccgcta

SEQ ID NO: 1368 - DNA, 32 bp, Artificial Sequence
  Description of Artificial Sequence: Synthetic spacer oligonucleotide
ttcgcaatccactgttgcccgtagattttcgc

SEQ ID NO: 1369 - DNA, 32 bp, Artificial Sequence
  Description of Artificial Sequence: Synthetic spacer oligonucleotide
atcgtctgctgtggaataaaaggtgagaaacg

SEQ ID NO: 1370 - DNA, 32 bp, Artificial Sequence
  Description of Artificial Sequence: Synthetic spacer oligonucleotide
tccagtgcgacactaagctcggaggatgtgat

SEQ ID NO: 1371 - DNA, 32 bp, Artificial Sequence
  Description of Artificial Sequence: Synthetic spacer oligonucleotide
aggaaaacgcatatgagcatacaaacaaccgg

SEQ ID NO: 1372 - DNA, 32 bp, Artificial Sequence
  Description of Artificial Sequence: Synthetic spacer oligonucleotide
cgatgtcacgccgccacatttgcggttatggg

SEQ ID NO: 1373 - DNA, 32 bp, Artificial Sequence
  Description of Artificial Sequence: Synthetic spacer oligonucleotide
gcccgacccagtaaggggaggggggggcgtga

SEQ ID NO: 1374 - DNA, 32 bp, Artificial Sequence
  Description of Artificial Sequence: Synthetic spacer oligonucleotide
gggcggactacgcgtgaaacaaaccagttctg

SEQ ID NO: 1375 - DNA, 32 bp, Artificial Sequence
  Description of Artificial Sequence: Synthetic spacer oligonucleotide
cttgccagtggatttttggttatctatgtagt

SEQ ID NO: 1376 - DNA, 32 bp, Artificial Sequence
  Description of Artificial Sequence: Synthetic spacer oligonucleotide
ttttaactcagccaccgtcgcatcacgatcta

SEQ ID NO: 1377 - DNA, 32 bp, Artificial Sequence
  Description of Artificial Sequence: Synthetic spacer oligonucleotide
tcccaatggtcaggggaacgcaggttgagttt

SEQ ID NO: 1378 - DNA, 33 bp, Artificial Sequence
  Description of Artificial Sequence: Synthetic spacer oligonucleotide
gcgtagttctgtctggcaaccatcgtgttcagg

SEQ ID NO: 1379 - DNA, 33 bp, Artificial Sequence
  Description of Artificial Sequence: Synthetic spacer oligonucleotide
gtctgattggtggcgtcgatattgaaaacaaac

SEQ ID NO: 1380 - DNA, 32 bp, Artificial Sequence
  Description of Artificial Sequence: Synthetic spacer oligonucleotide
gcgatatgatctctctcttcctttccctgatc

SEQ ID NO: 1381 - DNA, 32 bp, Artificial Sequence
  Description of Artificial Sequence: Synthetic spacer oligonucleotide
tgtatgacaacgatcaatttgtgcagggactg

SEQ ID NO: 1382 - DNA, 32 bp, Artificial Sequence
  Description of Artificial Sequence: Synthetic spacer oligonucleotide
acgaaaaataaaacttgcacgctttaaacgtg

SEQ ID NO: 1383 - DNA, 32 bp, Artificial Sequence
  Description of Artificial Sequence: Synthetic spacer oligonucleotide
tgacgagcagctacagagatttgaggagtcgg

SEQ ID NO: 1384 - DNA, 32 bp, Artificial Sequence
  Description of Artificial Sequence: Synthetic spacer oligonucleotide
tttttttgcaagattacggctcatattatttc

SEQ ID NO: 1385 - DNA, 32 bp, Artificial Sequence
  Description of Artificial Sequence: Synthetic spacer oligonucleotide
aataactcggttttaagctcctttgaagccag

SEQ ID NO: 1386 - DNA, 32 bp, Artificial Sequence
  Description of Artificial Sequence: Synthetic spacer oligonucleotide
ttgagctgttaccgcctccctgtgcgggcggg

SEQ ID NO: 1387 - DNA, 32 bp, Artificial Sequence
  Description of Artificial Sequence: Synthetic spacer oligonucleotide
ccgcgacatcaccgtccgtcaaaattaccgac

SEQ ID NO: 1388 - DNA, 32 bp, Artificial Sequence
  Description of Artificial Sequence: Synthetic spacer oligonucleotide
tggctttgcatacgtcactcatagacaaatca

SEQ ID NO: 1389 - DNA, 32 bp, Artificial Sequence
  Description of Artificial Sequence: Synthetic spacer oligonucleotide
gcaaggagacatgatcctacctgctgaagcac

SEQ ID NO: 1390 - DNA, 32 bp, Artificial Sequence
  Description of Artificial Sequence: Synthetic spacer oligonucleotide
tttgataaatatcacctggcctggtttcagtt

SEQ ID NO: 1391 - DNA, 32 bp, Artificial Sequence
  Description of Artificial Sequence: Synthetic spacer oligonucleotide
ttcacaatcgactcagcaatggagttaagaca

SEQ ID NO: 1392 - DNA, 32 bp, Artificial Sequence
  Description of Artificial Sequence: Synthetic spacer oligonucleotide
cccacctgcggaaattgaaactacagggtatg

SEQ ID NO: 1393 - DNA, 32 bp, Artificial Sequence
  Description of Artificial Sequence: Synthetic spacer oligonucleotide
gcagcagcaaagagaagcaacttttctcgggc

SEQ ID NO: 1394 - DNA, 32 bp, Artificial Sequence
  Description of Artificial Sequence: Synthetic spacer oligonucleotide
aagctgttcgtgtaccccttatagctggcgta

SEQ ID NO: 1395 - DNA, 32 bp, Artificial Sequence
  Description of Artificial Sequence: Synthetic spacer oligonucleotide
ttactccacgtaatcagatcgccgttcagccc

SEQ ID NO: 1396 - DNA, 32 bp, Artificial Sequence
  Description of Artificial Sequence: Synthetic spacer oligonucleotide
ttgatcgcaatatccacactgcgaccgacagc

SEQ ID NO: 1397 - DNA, 32 bp, Artificial Sequence
  Description of Artificial Sequence: Synthetic spacer oligonucleotide
tttttattggcggatgtgtggctgttcatttt

SEQ ID NO: 1398 - DNA, 32 bp, Artificial Sequence
  Description of Artificial Sequence: Synthetic spacer oligonucleotide
ttcccagtagcgctcctgacgggctaacgcgt

SEQ ID NO: 1399 - DNA, 32 bp, Artificial Sequence
  Description of Artificial Sequence: Synthetic spacer oligonucleotide
tgacggacaacgcggccagttagttttacctc

SEQ ID NO: 1400 - DNA, 32 bp, Artificial Sequence
  Description of Artificial Sequence: Synthetic spacer oligonucleotide
accagttcaccctcatgcatcggattcatacc

SEQ ID NO: 1401 - DNA, 32 bp, Artificial Sequence
  Description of Artificial Sequence: Synthetic spacer oligonucleotide
gccggtgtggcggtgtaaatttttattgaggt

SEQ ID NO: 1402 - DNA, 32 bp, Artificial Sequence
  Description of Artificial Sequence: Synthetic spacer oligonucleotide
cgccgccagttcgtcgccaattgccagccaga

SEQ ID NO: 1403 - DNA, 32 bp, Artificial Sequence
  Description of Artificial Sequence: Synthetic spacer oligonucleotide
ttcagatagttaattgatgatgtatggattta

SEQ ID NO: 1404 - DNA, 32 bp, Artificial Sequence
  Description of Artificial Sequence: Synthetic spacer oligonucleotide
acaacacacgccggcatcagcgccgatccgtt

SEQ ID NO: 1405 - DNA, 32 bp, Artificial Sequence
  Description of Artificial Sequence: Synthetic spacer oligonucleotide
atggtcttacgtattttattggagctgggatc

SEQ ID NO: 1406 - DNA, 32 bp, Artificial Sequence
  Description of Artificial Sequence: Synthetic spacer oligonucleotide
tccactggagacgattcgaaccactccagtag

SEQ ID NO: 1407 - DNA, 32 bp, Artificial Sequence
  Description of Artificial Sequence: Synthetic spacer oligonucleotide
cagggcgttaaagtcgctcatagaggcgtacg

SEQ ID NO: 1408 - DNA, 32 bp, Artificial Sequence
  Description of Artificial Sequence: Synthetic spacer oligonucleotide
cagccgcgcaccagacattcaactcgctgcgc

SEQ ID NO: 1409 - DNA, 32 bp, Artificial Sequence
  Description of Artificial Sequence: Synthetic spacer oligonucleotide
cccgctatagcgattatctggctctcgtttct

SEQ ID NO: 1410 - DNA, 32 bp, Artificial Sequence
  Description of Artificial Sequence: Synthetic spacer oligonucleotide
cacaaaaaatagcgtcggcaactgcgtgccgt

SEQ ID NO: 1411 - DNA, 32 bp, Artificial Sequence
  Description of Artificial Sequence: Synthetic spacer oligonucleotide
ttaaattctatataacccagggctttgaacac

SEQ ID NO: 1412 - DNA, 32 bp, Artificial Sequence
  Description of Artificial Sequence: Synthetic spacer oligonucleotide
ggcttcgttacttttgccagcgcagaacatgg

SEQ ID NO: 1413 - DNA, 32 bp, Artificial Sequence
  Description of Artificial Sequence: Synthetic spacer oligonucleotide
ctcagggtctcgtctgttagtttgttattggt

SEQ ID NO: 1414 - DNA, 32 bp, Artificial Sequence
  Description of Artificial Sequence: Synthetic spacer oligonucleotide
atacaccctgatttatgccgatccgccctggt

SEQ ID NO: 1415 - DNA, 32 bp, Artificial Sequence
  Description of Artificial Sequence: Synthetic spacer oligonucleotide
attttctgggttgtatggggaataaccgcagt

SEQ ID NO: 1416 - DNA, 32 bp, Artificial Sequence
  Description of Artificial Sequence: Synthetic spacer oligonucleotide
ggttgaatcttaattcaactacatctagtatt

SEQ ID NO: 1417 - DNA, 32 bp, Artificial Sequence
  Description of Artificial Sequence: Synthetic spacer oligonucleotide
gataacacgctgccgtaaccgttctcccgggc

SEQ ID NO: 1418 - DNA, 32 bp, Artificial Sequence
  Description of Artificial Sequence: Synthetic spacer oligonucleotide
ggaagtggtacaggtatcagtctggcgatatt

SEQ ID NO: 1419 - DNA, 32 bp, Artificial Sequence
  Description of Artificial Sequence: Synthetic spacer oligonucleotide
ttacgccagttctgcgcgattttctgatagtt

SEQ ID NO: 1420 - DNA, 32 bp, Artificial Sequence
  Description of Artificial Sequence: Synthetic spacer oligonucleotide
ttaaggggatgttatgtcgcagatgaacacgt

SEQ ID NO: 1421 - DNA, 32 bp, Artificial Sequence
  Description of Artificial Sequence: Synthetic spacer oligonucleotide
ggcgtacccgtatttagccataacattattca

SEQ ID NO: 1422 - DNA, 32 bp, Artificial Sequence
  Description of Artificial Sequence: Synthetic spacer oligonucleotide
cccaattatacgctgatagtaaatcaaaaaat

SEQ ID NO: 1423 - DNA, 32 bp, Artificial Sequence
  Description of Artificial Sequence: Synthetic spacer oligonucleotide
ccaccaataacaggggaatcattctgtactga

SEQ ID NO: 1424 - DNA, 32 bp, Artificial Sequence
  Description of Artificial Sequence: Synthetic spacer oligonucleotide
attaataatctgagtgttaacggcaactgcgg

SEQ ID NO: 1425 - DNA, 32 bp, Artificial Sequence
  Description of Artificial Sequence: Synthetic spacer oligonucleotide
ccagcaacgatagggaacaagtctaaatatgg

SEQ ID NO: 1426 - DNA, 32 bp, Artificial Sequence
  Description of Artificial Sequence: Synthetic spacer oligonucleotide
gactcgcggcatgtgcgtggagctggcgcgtc

SEQ ID NO: 1427 - DNA, 32 bp, Artificial Sequence
  Description of Artificial Sequence: Synthetic spacer oligonucleotide
acgtgtaacgctcggcgacaatatactgttct

SEQ ID NO: 1428 - DNA, 32 bp, Artificial Sequence
  Description of Artificial Sequence: Synthetic spacer oligonucleotide
atcactgacaggaattaccacttcgccagtac

SEQ ID NO: 1429 - DNA, 32 bp, Artificial Sequence
  Description of Artificial Sequence: Synthetic spacer oligonucleotide
taatattttttgtttgagtaatgtctgaatct

SEQ ID NO: 1430 - DNA, 32 bp, Artificial Sequence
  Description of Artificial Sequence: Synthetic spacer oligonucleotide
atcaaatgtagccgccctgattaattcattgt

SEQ ID NO: 1431 - DNA, 32 bp, Artificial Sequence
  Description of Artificial Sequence: Synthetic spacer oligonucleotide
attacttgcaggttggctaccctggagcatgg

SEQ ID NO: 1432 - DNA, 32 bp, Artificial Sequence
  Description of Artificial Sequence: Synthetic spacer oligonucleotide
tcacactctgcatttatcacgcagacagccag

SEQ ID NO: 1433 - DNA, 32 bp, Artificial Sequence
  Description of Artificial Sequence: Synthetic spacer oligonucleotide
catgtatttttagatgttccagaaccgtttga

SEQ ID NO: 1434 - DNA, 32 bp, Artificial Sequence
  Description of Artificial Sequence: Synthetic spacer oligonucleotide
ttccaatcatttatttcgaaattttgattttg

SEQ ID NO: 1435 - DNA, 32 bp, Artificial Sequence
  Description of Artificial Sequence: Synthetic spacer oligonucleotide
cagcgcggcctgacctggtacaactatcctcg

SEQ ID NO: 1436 - DNA, 32 bp, Artificial Sequence
  Description of Artificial Sequence: Synthetic spacer oligonucleotide
gaaggtacggggaaaacaaagattactcgttc

SEQ ID NO: 1437 - DNA, 32 bp, Artificial Sequence
  Description of Artificial Sequence: Synthetic spacer oligonucleotide
cccaggatagacattaaattcatatttaccat

SEQ ID NO: 1438 - DNA, 32 bp, Artificial Sequence
  Description of Artificial Sequence: Synthetic spacer oligonucleotide
gcacgcctcgcggcgcgacaaagttcattgcg

SEQ ID NO: 1439 - DNA, 32 bp, Artificial Sequence
  Description of Artificial Sequence: Synthetic spacer oligonucleotide
aaaaataccggccatatagcgcttggctttgt

SEQ ID NO: 1440 - DNA, 32 bp, Artificial Sequence
  Description of Artificial Sequence: Synthetic spacer oligonucleotide
ctgtggtatgagctgattgaaccgcaaaaaat

SEQ ID NO: 1441 - DNA, 32 bp, Artificial Sequence
  Description of Artificial Sequence: Synthetic spacer oligonucleotide
aagagtcagtatgctaccgcaatagccaatct

SEQ ID NO: 1442 - DNA, 32 bp, Artificial Sequence
  Description of Artificial Sequence: Synthetic spacer oligonucleotide
caccggagcactgccagttcaccacgactctc

SEQ ID NO: 1443 - DNA, 32 bp, Artificial Sequence
  Description of Artificial Sequence: Synthetic spacer oligonucleotide
tcaacacgcgtcgctacgtagcgcatggcgtc

SEQ ID NO: 1444 - DNA, 32 bp, Artificial Sequence
  Description of Artificial Sequence: Synthetic spacer oligonucleotide
ttcacatcttcaggtaacatccccaattcctg

SEQ ID NO: 1445 - DNA, 32 bp, Artificial Sequence
  Description of Artificial Sequence: Synthetic spacer oligonucleotide
aggccgcagcaggtgatcaaaatacgtatctg

SEQ ID NO: 1446 - DNA, 32 bp, Artificial Sequence
  Description of Artificial Sequence: Synthetic spacer oligonucleotide
ttcgtgcctcttcccacgcgttacgaaggccg

SEQ ID NO: 1447 - DNA, 32 bp, Artificial Sequence
  Description of Artificial Sequence: Synthetic spacer oligonucleotide
aagtgcaccccctcaataaaaattccggtgcg

SEQ ID NO: 1448 - DNA, 32 bp, Artificial Sequence
  Description of Artificial Sequence: Synthetic spacer oligonucleotide
ctcagcaggctggaggagatgatcaaaaatga

SEQ ID NO: 1449 - DNA, 32 bp, Artificial Sequence
  Description of Artificial Sequence: Synthetic spacer oligonucleotide
gaacgtgcggaacaaaatataattccagagaa

SEQ ID NO: 1450 - DNA, 32 bp, Artificial Sequence
  Description of Artificial Sequence: Synthetic spacer oligonucleotide
tgttgatggtaaagaggtggcggatattgatc

SEQ ID NO: 1451 - DNA, 32 bp, Artificial Sequence
  Description of Artificial Sequence: Synthetic spacer oligonucleotide
atatgaaatgagcggatgaactaccaattacg

SEQ ID NO: 1452 - DNA, 32 bp, Artificial Sequence
  Description of Artificial Sequence: Synthetic spacer oligonucleotide
cttcccgagatggagagtttgcagcataaagc

SEQ ID NO: 1453 - DNA, 32 bp, Artificial Sequence
  Description of Artificial Sequence: Synthetic spacer oligonucleotide
tactgaggaaaacccaaaaacgcctgatttcg

SEQ ID NO: 1454 - DNA, 32 bp, Artificial Sequence
  Description of Artificial Sequence: Synthetic spacer oligonucleotide
atggcctggccaatcctcgccgatgtcctgcg

SEQ ID NO: 1455 - DNA, 32 bp, Artificial Sequence
  Description of Artificial Sequence: Synthetic spacer oligonucleotide
tggcgataatgtacgacgagttgccaaaatat

SEQ ID NO: 1456 - DNA, 32 bp, Artificial Sequence
  Description of Artificial Sequence: Synthetic spacer oligonucleotide
gcattgaaaacgggccagaaaaatagataatt

SEQ ID NO: 1457 - DNA, 32 bp, Artificial Sequence
  Description of Artificial Sequence: Synthetic spacer oligonucleotide
agcggtgttctcaatacccacgacagccgccc

SEQ ID NO: 1458 - DNA, 32 bp, Artificial Sequence
  Description of Artificial Sequence: Synthetic spacer oligonucleotide
ttactacggcggtaccgtagttttaccgtcag

SEQ ID NO: 1459 - DNA, 32 bp, Artificial Sequence
  Description of Artificial Sequence: Synthetic spacer oligonucleotide
aaaagattgagtcagcacataatcacagtttg

SEQ ID NO: 1460 - DNA, 32 bp, Artificial Sequence
  Description of Artificial Sequence: Synthetic spacer oligonucleotide
tgcgacggaatgcacctggcgccagaaatatt

SEQ ID NO: 1461 - DNA, 33 bp, Artificial Sequence
  Description of Artificial Sequence: Synthetic spacer oligonucleotide
gcgcgccgagccgagctgatagagcagatacgg

SEQ ID NO: 1462 - DNA, 32 bp, Artificial Sequence
  Description of Artificial Sequence: Synthetic spacer oligonucleotide
acctgtatcacctcgctaaaatctggcgcgaa

SEQ ID NO: 1463 - DNA, 32 bp, Artificial Sequence
  Description of Artificial Sequence: Synthetic spacer oligonucleotide
gtttcacgtagcgcctgtttgtcgatgttgct

SEQ ID NO: 1464 - DNA, 32 bp, Artificial Sequence
  Description of Artificial Sequence: Synthetic spacer oligonucleotide
atcacggcttacgaaaccgtttcgcgatagct

SEQ ID NO: 1465 - DNA, 33 bp, Artificial Sequence
  Description of Artificial Sequence: Synthetic spacer oligonucleotide
ggcgatggaggtgatggaatgtatgaggcacgc

SEQ ID NO: 1466 - DNA, 32 bp, Artificial Sequence
  Description of Artificial Sequence: Synthetic spacer oligonucleotide
tataaggcgcggctttactgtgaatccagggg

SEQ ID NO: 1467 - DNA, 32 bp, Artificial Sequence
  Description of Artificial Sequence: Synthetic spacer oligonucleotide
ggcggcgtatccgttatgaccgaatgccctaa

SEQ ID NO: 1468 - DNA, 32 bp, Artificial Sequence
  Description of Artificial Sequence: Synthetic spacer oligonucleotide
atattcactgagtaaatgtattctccatatgc

SEQ ID NO: 1469 - DNA, 32 bp, Artificial Sequence
  Description of Artificial Sequence: Synthetic spacer oligonucleotide
acaaagggaattaaaatgaacaaatcagtaat

SEQ ID NO: 1470 - DNA, 32 bp, Artificial Sequence
  Description of Artificial Sequence: Synthetic spacer oligonucleotide
cgtccccggcgtgctctgctcaaaagataacg

SEQ ID NO: 1471 - DNA, 32 bp, Artificial Sequence
  Description of Artificial Sequence: Synthetic spacer oligonucleotide
gcctgacgcagtgcgagagcggttaacagcga

SEQ ID NO: 1472 - DNA, 32 bp, Artificial Sequence
  Description of Artificial Sequence: Synthetic spacer oligonucleotide
gttttaaccgtgtttatatcctatccgtgata

SEQ ID NO: 1473 - DNA, 32 bp, Artificial Sequence
  Description of Artificial Sequence: Synthetic spacer oligonucleotide
gtatccagcacatcagcaccggtaacatcgtc

SEQ ID NO: 1474 - DNA, 32 bp, Artificial Sequence
  Description of Artificial Sequence: Synthetic spacer oligonucleotide
ggcgataggtagcgggctacaaaattaaacat

SEQ ID NO: 1475 - DNA, 32 bp, Artificial Sequence
  Description of Artificial Sequence: Synthetic spacer oligonucleotide
taaatatcggttaaccctgtgccgtccggctg

SEQ ID NO: 1476 - DNA, 32 bp, Artificial Sequence
  Description of Artificial Sequence: Synthetic spacer oligonucleotide
gcgtggtctgagtggtcaactattcagagcgg

SEQ ID NO: 1477 - DNA, 32 bp, Artificial Sequence
  Description of Artificial Sequence: Synthetic spacer oligonucleotide
tgatgagtattcagccggttaaagagggtcga

SEQ ID NO: 1478 - DNA, 32 bp, Artificial Sequence
  Description of Artificial Sequence: Synthetic spacer oligonucleotide
gatctacgacaggctggcacccggcgaggaac

SEQ ID NO: 1479 - DNA, 32 bp, Artificial Sequence
  Description of Artificial Sequence: Synthetic spacer oligonucleotide
gcgagaccaacaaaaatttgtttgagcgtacc

SEQ ID NO: 1480 - DNA, 32 bp, Artificial Sequence
  Description of Artificial Sequence: Synthetic spacer oligonucleotide
aactgacaaccccgtgccgtcgggttggattt

SEQ ID NO: 1481 - DNA, 32 bp, Artificial Sequence
  Description of Artificial Sequence: Synthetic spacer oligonucleotide
gccgcctccacaaatactgccgcgtctgtatt

SEQ ID NO: 1482 - DNA, 32 bp, Artificial Sequence
  Description of Artificial Sequence: Synthetic spacer oligonucleotide
agctgcaccgccacgaatctgcgccttccacg

SEQ ID NO: 1483 - DNA, 32 bp, Artificial Sequence
  Description of Artificial Sequence: Synthetic spacer oligonucleotide
agtgcgtttctgcgctcacgctcacgtgacag

SEQ ID NO: 1484 - DNA, 32 bp, Artificial Sequence
  Description of Artificial Sequence: Synthetic spacer oligonucleotide
agcgttgataagaactccctgcggcgtccagt

SEQ ID NO: 1485 - DNA, 33 bp, Artificial Sequence
  Description of Artificial Sequence: Synthetic spacer oligonucleotide
gtcatgaaatccacctgaacggatgaaagggcg

SEQ ID NO: 1486 - DNA, 32 bp, Artificial Sequence
  Description of Artificial Sequence: Synthetic spacer oligonucleotide
gttgatttccccgtaccggtgctaccaattat

SEQ ID NO: 1487 - DNA, 32 bp, Artificial Sequence
  Description of Artificial Sequence: Synthetic spacer oligonucleotide
gatgttatcaacgtcaacgttaaacgtgtcca

SEQ ID NO: 1488 - DNA, 32 bp, Artificial Sequence
  Description of Artificial Sequence: Synthetic spacer oligonucleotide
ttgaagttcggcgtaaatttctgattttatct

SEQ ID NO: 1489 - DNA, 32 bp, Artificial Sequence
  Description of Artificial Sequence: Synthetic spacer oligonucleotide
cccgtaaccagtgctagcgccattgcgtgggg

SEQ ID NO: 1490 - DNA, 32 bp, Artificial Sequence
  Description of Artificial Sequence: Synthetic spacer oligonucleotide
cggaatccccaacccctcaaacgtacgtaatt

SEQ ID NO: 1491 - DNA, 32 bp, Artificial Sequence
  Description of Artificial Sequence: Synthetic spacer oligonucleotide
ggaggatgcgccacaatccaagcacgcgatta

SEQ ID NO: 1492 - DNA, 32 bp, Artificial Sequence
  Description of Artificial Sequence: Synthetic spacer oligonucleotide
caccatgacgcatcccacggccatccccacgg

SEQ ID NO: 1493 - DNA, 32 bp, Artificial Sequence
  Description of Artificial Sequence: Synthetic spacer oligonucleotide
tgcgacccggccggaccgggcaccattaccac

SEQ ID NO: 1494 - DNA, 32 bp, Artificial Sequence
  Description of Artificial Sequence: Synthetic spacer oligonucleotide
tgcgacccggccggaccgggcaccatcaccac

SEQ ID NO: 1495 - DNA, 32 bp, Artificial Sequence
  Description of Artificial Sequence: Synthetic spacer oligonucleotide
gggcaaacaacggttgccggtgcgtaatccct

SEQ ID NO: 1496 - DNA, 32 bp, Artificial Sequence
  Description of Artificial Sequence: Synthetic spacer oligonucleotide
gcattcgtgtgcgcgaataagtccggtcgttc

SEQ ID NO: 1497 - DNA, 32 bp, Artificial Sequence
  Description of Artificial Sequence: Synthetic spacer oligonucleotide
tcgtccatcattccgcgccacctatacaggcg

SEQ ID NO: 1498 - DNA, 32 bp, Artificial Sequence
  Description of Artificial Sequence: Synthetic spacer oligonucleotide
cgttgcgacataggctcatctgacgctgaata

SEQ ID NO: 1499 - DNA, 32 bp, Artificial Sequence
  Description of Artificial Sequence: Synthetic spacer oligonucleotide
tcgtttgccattacatcccccgattaatcagg

SEQ ID NO: 1500 - DNA, 32 bp, Artificial Sequence
  Description of Artificial Sequence: Synthetic spacer oligonucleotide
aaggctctgtcattccacctttgagtgttaaa

SEQ ID NO: 1501 - DNA, 32 bp, Artificial Sequence
  Description of Artificial Sequence: Synthetic spacer oligonucleotide
gcgttagccatttggactattttcccggtgga

SEQ ID NO: 1502 - DNA, 32 bp, Artificial Sequence
  Description of Artificial Sequence: Synthetic spacer oligonucleotide
aatgcgcggcgctggcggcggagaatgtgggg

SEQ ID NO: 1503 - DNA, 32 bp, Artificial Sequence
  Description of Artificial Sequence: Synthetic spacer oligonucleotide
cactggaaagaaagccgccagactgaaagagg

SEQ ID NO: 1504 - DNA, 32 bp, Artificial Sequence
  Description of Artificial Sequence: Synthetic spacer oligonucleotide
gtcactcgacgtcgtgtgaaacatatctaaaa

SEQ ID NO: 1505 - DNA, 32 bp, Artificial Sequence
  Description of Artificial Sequence: Synthetic spacer oligonucleotide
ttttcgcatcggttaaagcgcgaacaaatgcc

SEQ ID NO: 1506 - DNA, 32 bp, Artificial Sequence
  Description of Artificial Sequence: Synthetic spacer oligonucleotide
tgcatttttagccgctgagtcgtattgactag

SEQ ID NO: 1507 - DNA, 32 bp, Artificial Sequence
  Description of Artificial Sequence: Synthetic spacer oligonucleotide
tgcgaaacctgcgatttactgacgccgaccgc

SEQ ID NO: 1508 - DNA, 32 bp, Artificial Sequence
  Description of Artificial Sequence: Synthetic spacer oligonucleotide
cgtgccaggcgcagggaatgacctggcggaaa

SEQ ID NO: 1509 - DNA, 31 bp, Artificial Sequence
  Description of Artificial Sequence: Synthetic spacer oligonucleotide
ggattagcggtgcttctggtggtatcgggtt

SEQ ID NO: 1510 - DNA, 32 bp, Artificial Sequence
  Description of Artificial Sequence: Synthetic spacer oligonucleotide
gcgcaggcggtgccgatagtaaacgggtaaat

SEQ ID NO: 1511 - DNA, 32 bp, Artificial Sequence
  Description of Artificial Sequence: Synthetic spacer oligonucleotide
acacgcaggcgcaaatacgccgcccctgcacc

SEQ ID NO: 1512 - DNA, 32 bp, Artificial Sequence
  Description of Artificial Sequence: Synthetic spacer oligonucleotide
tcagacaggtactcctcgcggcgctccaccag

SEQ ID NO: 1513 - DNA, 32 bp, Artificial Sequence
  Description of Artificial Sequence: Synthetic spacer oligonucleotide
tcgtccgtaatcacggccaccacgcctgatgc

SEQ ID NO: 1514 - DNA, 32 bp, Artificial Sequence
  Description of Artificial Sequence: Synthetic spacer oligonucleotide
attctgccgcgtgagcaataaccgggggatcg

SEQ ID NO: 1515 - DNA, 32 bp, Artificial Sequence
  Description of Artificial Sequence: Synthetic spacer oligonucleotide
ctggctgtcgagttccgattcaattgtcgcgg

SEQ ID NO: 1516 - DNA, 32 bp, Artificial Sequence
  Description of Artificial Sequence: Synthetic spacer oligonucleotide
taaaacttgacgccgcttacaatcaggcaacc

SEQ ID NO: 1517 - DNA, 32 bp, Artificial Sequence
  Description of Artificial Sequence: Synthetic spacer oligonucleotide
ctggtcaagcgtgcgacgcgcacggcgtttgc

SEQ ID NO: 1518 - DNA, 32 bp, Artificial Sequence
  Description of Artificial Sequence: Synthetic spacer oligonucleotide
ctcgactctatcaaatctattgagggtgttga

SEQ ID NO: 1519 - DNA, 32 bp, Artificial Sequence
  Description of Artificial Sequence: Synthetic spacer oligonucleotide
gaagcattgttagaattaagctcacgtctcgc

SEQ ID NO: 1520 - DNA, 32 bp, Artificial Sequence
  Description of Artificial Sequence: Synthetic spacer oligonucleotide
cagtgccgcattctctctaaaggtaatccgcg

SEQ ID NO: 1521 - DNA, 32 bp, Artificial Sequence
  Description of Artificial Sequence: Synthetic spacer oligonucleotide
ctcactgtcgagatagctgttgtccgcctccc

SEQ ID NO: 1522 - DNA, 32 bp, Artificial Sequence
  Description of Artificial Sequence: Synthetic spacer oligonucleotide
ggctttccgcagtgctgccggatcagtccagt

SEQ ID NO: 1523 - DNA, 32 bp, Artificial Sequence
  Description of Artificial Sequence: Synthetic spacer oligonucleotide
ctaaatccgtgaattttgtctggtatcagcgg

SEQ ID NO: 1524 - DNA, 32 bp, Artificial Sequence
  Description of Artificial Sequence: Synthetic spacer oligonucleotide
atgttctgccccagcaccagcgccgtaactgc

SEQ ID NO: 1525 - DNA, 32 bp, Artificial Sequence
  Description of Artificial Sequence: Synthetic spacer oligonucleotide
atgttctgccccagcaccagcgctgtaactgc

SEQ ID NO: 1526 - DNA, 32 bp, Artificial Sequence
  Description of Artificial Sequence: Synthetic spacer oligonucleotide
caaaatattcaactgtctgcccgcaggtgggg

SEQ ID NO: 1527 - DNA, 32 bp, Artificial Sequence
  Description of Artificial Sequence: Synthetic spacer oligonucleotide
aggaaggcactcagaaacaggttaataattct

SEQ ID NO: 1528 - DNA, 30 bp, Artificial Sequence
  Description of Artificial Sequence: Synthetic spacer oligonucleotide
gagaatgctcatgcgtgagcgccatatatt

SEQ ID NO: 1529 - DNA, 32 bp, Artificial Sequence
  Description of Artificial Sequence: Synthetic spacer oligonucleotide
ctgcaatatgggaaatgattatttaattattt

SEQ ID NO: 1530 - DNA, 32 bp, Artificial Sequence
  Description of Artificial Sequence: Synthetic spacer oligonucleotide
gacggaaatatcaggccatatccgcctatagt

SEQ ID NO: 1531 - DNA, 32 bp, Artificial Sequence
  Description of Artificial Sequence: Synthetic spacer oligonucleotide
gaggccatgatgctaatcgctgagcagcagga

SEQ ID NO: 1532 - DNA, 32 bp, Artificial Sequence
  Description of Artificial Sequence: Synthetic spacer oligonucleotide
aaaacccccgaaggtcaaaggcggcacaccgt

SEQ ID NO: 1533 - DNA, 32 bp, Artificial Sequence
  Description of Artificial Sequence: Synthetic spacer oligonucleotide
tataatagttcacctgctcggcaaccataagc

SEQ ID NO: 1534 - DNA, 32 bp, Artificial Sequence
  Description of Artificial Sequence: Synthetic spacer oligonucleotide
ccgggaagcgctgaacgagatgattgggctac

SEQ ID NO: 1535 - DNA, 32 bp, Artificial Sequence
  Description of Artificial Sequence: Synthetic spacer oligonucleotide
atgaacgtttataccgcgccaactatccacca

SEQ ID NO: 1536 - DNA, 32 bp, Artificial Sequence
  Description of Artificial Sequence: Synthetic spacer oligonucleotide
gcttgaaaccatgctggaacaggcagacggaa

SEQ ID NO: 1537 - DNA, 32 bp, Artificial Sequence
  Description of Artificial Sequence: Synthetic spacer oligonucleotide
gagcgctgttgagtttgtatccgcgttcgcgt

SEQ ID NO: 1538 - DNA, 32 bp, Artificial Sequence
  Description of Artificial Sequence: Synthetic spacer oligonucleotide
tgtcaaccgaaggcgattccgtggtcggccag

SEQ ID NO: 1539 - DNA, 32 bp, Artificial Sequence
  Description of Artificial Sequence: Synthetic spacer oligonucleotide
gtgattttcatagccgcgttgagctgcccgat

SEQ ID NO: 1540 - DNA, 32 bp, Artificial Sequence
  Description of Artificial Sequence: Synthetic spacer oligonucleotide
atccgcgtcggaacagtcgccggtcgtgatgc

SEQ ID NO: 1541 - DNA, 32 bp, Artificial Sequence
  Description of Artificial Sequence: Synthetic spacer oligonucleotide
acgtcccgccccaccagcggcttaaatccgca

SEQ ID NO: 1542 - DNA, 32 bp, Artificial Sequence
  Description of Artificial Sequence: Synthetic spacer oligonucleotide
ggatctcttcatcgctatccggtaacagaaag

SEQ ID NO: 1543 - DNA, 32 bp, Artificial Sequence
  Description of Artificial Sequence: Synthetic spacer oligonucleotide
gctgtcaaccgtgcctgttgattttgccgtcc

SEQ ID NO: 1544 - DNA, 32 bp, Artificial Sequence
  Description of Artificial Sequence: Synthetic spacer oligonucleotide
tcgcccgttgatttcaacaggccccggtaatc

SEQ ID NO: 1545 - DNA, 32 bp, Artificial Sequence
  Description of Artificial Sequence: Synthetic spacer oligonucleotide
gcgatggctgctgataatttgccaaaaatacc

SEQ ID NO: 1546 - DNA, 32 bp, Artificial Sequence
  Description of Artificial Sequence: Synthetic spacer oligonucleotide
gaatctggaggccaacagcgcggcgaaatact

SEQ ID NO: 1547 - DNA, 32 bp, Artificial Sequence
  Description of Artificial Sequence: Synthetic spacer oligonucleotide
gaaattagtattcgcgatagcgtccgtttttc

SEQ ID NO: 1548 - DNA, 32 bp, Artificial Sequence
  Description of Artificial Sequence: Synthetic spacer oligonucleotide
ttgttcaggtcgtagattcgttgtgattggcc

SEQ ID NO: 1549 - DNA, 32 bp, Artificial Sequence
  Description of Artificial Sequence: Synthetic spacer oligonucleotide
tccgtttacgatattccggcatcgtatttcgg

SEQ ID NO: 1550 - DNA, 32 bp, Artificial Sequence
  Description of Artificial Sequence: Synthetic spacer oligonucleotide
accgttccggtatgatcgaagatacggcaaac

SEQ ID NO: 1551 - DNA, 32 bp, Artificial Sequence
  Description of Artificial Sequence: Synthetic spacer oligonucleotide
atttttaattgcgcgcattatgtcgccaaaag

SEQ ID NO: 1552 - DNA, 32 bp, Artificial Sequence
  Description of Artificial Sequence: Synthetic spacer oligonucleotide
tatatgcgctttaatacggttgagtccggtcg

SEQ ID NO: 1553 - DNA, 32 bp, Artificial Sequence
  Description of Artificial Sequence: Synthetic spacer oligonucleotide
aaattttgcgccttgtctaaatggtcgtaagt

SEQ ID NO: 1554 - DNA, 33 bp, Artificial Sequence
  Description of Artificial Sequence: Synthetic spacer oligonucleotide
ccgcaacgcataaacactggaggtgtcagcacc

SEQ ID NO: 1555 - DNA, 32 bp, Artificial Sequence
  Description of Artificial Sequence: Synthetic spacer oligonucleotide
tgatgaaatcgtcaataaaattattggcgcgc

SEQ ID NO: 1556 - DNA, 32 bp, Artificial Sequence
  Description of Artificial Sequence: Synthetic spacer oligonucleotide
accaccggagccatcgcccaacacagagccgc

SEQ ID NO: 1557 - DNA, 32 bp, Artificial Sequence
  Description of Artificial Sequence: Synthetic spacer oligonucleotide
ggcaaacccgcaaggcccgtatatggatttaa

SEQ ID NO: 1558 - DNA, 32 bp, Artificial Sequence
  Description of Artificial Sequence: Synthetic spacer oligonucleotide
aaccaatccaggcgataagaggcgattaaagg

SEQ ID NO: 1559 - DNA, 32 bp, Artificial Sequence
  Description of Artificial Sequence: Synthetic spacer oligonucleotide
attttatttgacaaattggcggcatctcactg

SEQ ID NO: 1560 - DNA, 32 bp, Artificial Sequence
  Description of Artificial Sequence: Synthetic spacer oligonucleotide
caccacacataatgattactccactacccagc

SEQ ID NO: 1561 - DNA, 32 bp, Artificial Sequence
  Description of Artificial Sequence: Synthetic spacer oligonucleotide
actgcttatcattgattttattgatttttccc

SEQ ID NO: 1562 - DNA, 32 bp, Artificial Sequence
  Description of Artificial Sequence: Synthetic spacer oligonucleotide
tacaaggttaatactgactattgttatgaatt

SEQ ID NO: 1563 - DNA, 33 bp, Artificial Sequence
  Description of Artificial Sequence: Synthetic spacer oligonucleotide
atattgatgccaatttacatcattacttaaaac

SEQ ID NO: 1564 - DNA, 32 bp, Artificial Sequence
  Description of Artificial Sequence: Synthetic spacer oligonucleotide
ttccatcccgtcgttttcggttttgagatagt

SEQ ID NO: 1565 - DNA, 32 bp, Artificial Sequence
  Description of Artificial Sequence: Synthetic spacer oligonucleotide
gggcattagcgaatcctccacacactcagcgg

SEQ ID NO: 1566 - DNA, 32 bp, Artificial Sequence
  Description of Artificial Sequence: Synthetic spacer oligonucleotide
gagacgctcaaatatagacgccatcaaaccac

SEQ ID NO: 1567 - DNA, 32 bp, Artificial Sequence
  Description of Artificial Sequence: Synthetic spacer oligonucleotide
aaaaatcagcgggaccagtgacacggtgctgt

SEQ ID NO: 1568 - DNA, 32 bp, Artificial Sequence
  Description of Artificial Sequence: Synthetic spacer oligonucleotide
tcagtgaggcggcgcgctgcatacgcctggat

SEQ ID NO: 1569 - DNA, 32 bp, Artificial Sequence
  Description of Artificial Sequence: Synthetic spacer oligonucleotide
aatatttcgcggcagtagtggctggtgtgaaa

SEQ ID NO: 1570 - DNA, 32 bp, Artificial Sequence
  Description of Artificial Sequence: Synthetic spacer oligonucleotide
ggtgaaggcaagcctggatgtagatgtttgct

SEQ ID NO: 1571 - DNA, 32 bp, Artificial Sequence
  Description of Artificial Sequence: Synthetic spacer oligonucleotide
cgtcaccagcgtcgatttttcacctttccgaa

SEQ ID NO: 1572 - DNA, 32 bp, Artificial Sequence
  Description of Artificial Sequence: Synthetic spacer oligonucleotide
atcaggttcacctcgcgaatatcgtcgctgcc

SEQ ID NO: 1573 - DNA, 32 bp, Artificial Sequence
  Description of Artificial Sequence: Synthetic spacer oligonucleotide
ctcgtcagtaatgtatctgtcccgcccgtcct

SEQ ID NO: 1574 - DNA, 32 bp, Artificial Sequence
  Description of Artificial Sequence: Synthetic spacer oligonucleotide
ggccatgagttaccggctgcgcatcgggcaac

SEQ ID NO: 1575 - DNA, 32 bp, Artificial Sequence
  Description of Artificial Sequence: Synthetic spacer oligonucleotide
tactgcgtgtataaaactcaccccggcgcggg

SEQ ID NO: 1576 - DNA, 32 bp, Artificial Sequence
  Description of Artificial Sequence: Synthetic spacer oligonucleotide
gcgtgtaaccgctcgtacccccggtatccaga

SEQ ID NO: 1577 - DNA, 32 bp, Artificial Sequence
  Description of Artificial Sequence: Synthetic spacer oligonucleotide
tttttacaggatggcgatttctccgtacgagt

SEQ ID NO: 1578 - DNA, 32 bp, Artificial Sequence
  Description of Artificial Sequence: Synthetic spacer oligonucleotide
aagaatacctggacggcaccgggctgggtaat

SEQ ID NO: 1579 - DNA, 32 bp, Artificial Sequence
  Description of Artificial Sequence: Synthetic spacer oligonucleotide
gggggtcttatgatctacggtactcaggaagt

SEQ ID NO: 1580 - DNA, 32 bp, Artificial Sequence
  Description of Artificial Sequence: Synthetic spacer oligonucleotide
gcccatcatctggctgtttgttgcctcgacgg

SEQ ID NO: 1581 - DNA, 32 bp, Artificial Sequence
  Description of Artificial Sequence: Synthetic spacer oligonucleotide
gccgcccccattgaacgaggtatcctcgttag

SEQ ID NO: 1582 - DNA, 32 bp, Artificial Sequence
  Description of Artificial Sequence: Synthetic spacer oligonucleotide
tcgctggctgccgggcagacgaagccgatcga

SEQ ID NO: 1583 - DNA, 32 bp, Artificial Sequence
  Description of Artificial Sequence: Synthetic spacer oligonucleotide
ccgctactgcgatgtacagcaacgatccgggt

SEQ ID NO: 1584 - DNA, 32 bp, Artificial Sequence
  Description of Artificial Sequence: Synthetic spacer oligonucleotide
gcgcaatatcagactcggtcaaagtctgtttt

SEQ ID NO: 1585 - DNA, 32 bp, Artificial Sequence
  Description of Artificial Sequence: Synthetic spacer oligonucleotide
gaataagccggtgtaggtttcgggcgcgtgat

SEQ ID NO: 1586 - DNA, 32 bp, Artificial Sequence
  Description of Artificial Sequence: Synthetic spacer oligonucleotide
ttaaaacttcttgtgctggttatatctgaata

SEQ ID NO: 1587 - DNA, 32 bp, Artificial Sequence
  Description of Artificial Sequence: Synthetic spacer oligonucleotide
gcccttatgtttgaagctcttgatcatggcgt

SEQ ID NO: 1588 - DNA, 32 bp, Artificial Sequence
  Description of Artificial Sequence: Synthetic spacer oligonucleotide
ctccctcgcctcatctggagtggaggcataaa

SEQ ID NO: 1589 - DNA, 32 bp, Artificial Sequence
  Description of Artificial Sequence: Synthetic spacer oligonucleotide
accgagttactgccagatatatgttgataatg

SEQ ID NO: 1590 - DNA, 32 bp, Artificial Sequence
  Description of Artificial Sequence: Synthetic spacer oligonucleotide
acttcgagtgatggaaagacaggagttgtctt

SEQ ID NO: 1591 - DNA, 32 bp, Artificial Sequence
  Description of Artificial Sequence: Synthetic spacer oligonucleotide
ctattaagtccctcgcgcccgctgcgcataaa

SEQ ID NO: 1592 - DNA, 32 bp, Artificial Sequence
  Description of Artificial Sequence: Synthetic spacer oligonucleotide
agaatacgaatgattagccccgcctgaccctg

SEQ ID NO: 1593 - DNA, 32 bp, Artificial Sequence
  Description of Artificial Sequence: Synthetic spacer oligonucleotide
tttggtgaacgcaccgggaatgacaatatctc

SEQ ID NO: 1594 - DNA, 32 bp, Artificial Sequence
  Description of Artificial Sequence: Synthetic spacer oligonucleotide
tttttatcggtgtggttcggccgtaacgttga

SEQ ID NO: 1595 - DNA, 32 bp, Artificial Sequence
  Description of Artificial Sequence: Synthetic spacer oligonucleotide
ataatcagcgaaatcgtcagcagtggcgtacc

SEQ ID NO: 1596 - DNA, 33 bp, Artificial Sequence
  Description of Artificial Sequence: Synthetic spacer oligonucleotide
ccagccactgccggaaaccacgctcatcccacc

SEQ ID NO: 1597 - DNA, 32 bp, Artificial Sequence
  Description of Artificial Sequence: Synthetic spacer oligonucleotide
gttggcgcgcctttgcggggagcaaaaccaag

SEQ ID NO: 1598 - DNA, 32 bp, Artificial Sequence
  Description of Artificial Sequence: Synthetic spacer oligonucleotide
cgtaattaacgataaaacagctaaagcccgta

SEQ ID NO: 1599 - DNA, 32 bp, Artificial Sequence
  Description of Artificial Sequence: Synthetic spacer oligonucleotide
ttgctctgcggcaagcccgtcacaatattgat

SEQ ID NO: 1600 - DNA, 32 bp, Artificial Sequence
  Description of Artificial Sequence: Synthetic spacer oligonucleotide
ggaattgttgtaatgggaactggtttagctat

SEQ ID NO: 1601 - DNA, 32 bp, Artificial Sequence
  Description of Artificial Sequence: Synthetic spacer oligonucleotide
tttatgagcattttccagcgactctccacttc

SEQ ID NO: 1602 - DNA, 32 bp, Artificial Sequence
  Description of Artificial Sequence: Synthetic spacer oligonucleotide
tttaattaaatattaataggttacactcaccc

SEQ ID NO: 1603 - DNA, 32 bp, Artificial Sequence
  Description of Artificial Sequence: Synthetic spacer oligonucleotide
tgctggaaaaactggtgccgatctcctgctct

SEQ ID NO: 1604 - DNA, 32 bp, Artificial Sequence
  Description of Artificial Sequence: Synthetic spacer oligonucleotide
ttggtaaattatacaggcgtaaatggcgtggc

SEQ ID NO: 1605 - DNA, 32 bp, Artificial Sequence
  Description of Artificial Sequence: Synthetic spacer oligonucleotide
attatttgcaggtgattttatgaaattagagg

SEQ ID NO: 1606 - DNA, 32 bp, Artificial Sequence
  Description of Artificial Sequence: Synthetic spacer oligonucleotide
ctcaaaacacgcaaaaacggcactcaaaaggc

SEQ ID NO: 1607 - DNA, 32 bp, Artificial Sequence
  Description of Artificial Sequence: Synthetic spacer oligonucleotide
ggccgccgcctcacccgcgctaccgatactgg

SEQ ID NO: 1608 - DNA, 32 bp, Artificial Sequence
  Description of Artificial Sequence: Synthetic spacer oligonucleotide
tgaccagtacgaatgccatcggcgatttttgt

SEQ ID NO: 1609 - DNA, 32 bp, Artificial Sequence
  Description of Artificial Sequence: Synthetic spacer oligonucleotide
tcaaattatgagtcagggcgtaacactccagc

SEQ ID NO: 1610 - DNA, 32 bp, Artificial Sequence
  Description of Artificial Sequence: Synthetic spacer oligonucleotide
tccgaacgcctgccatctgtctgcctgggccg

SEQ ID NO: 1611 - DNA, 32 bp, Artificial Sequence
  Description of Artificial Sequence: Synthetic spacer oligonucleotide
aacgacatgcatccgcgtaacggcgaggaata

SEQ ID NO: 1612 - DNA, 32 bp, Artificial Sequence
  Description of Artificial Sequence: Synthetic spacer oligonucleotide
accacaactggcctggcgctggaggcattcaa

SEQ ID NO: 1613 - DNA, 32 bp, Artificial Sequence
  Description of Artificial Sequence: Synthetic spacer oligonucleotide
tttagcatcgtttgctggtcgtatttcgttta

SEQ ID NO: 1614 - DNA, 32 bp, Artificial Sequence
  Description of Artificial Sequence: Synthetic spacer oligonucleotide
ttaagcgttacggagaagcggcagatgccatg

SEQ ID NO: 1615 - DNA, 32 bp, Artificial Sequence
  Description of Artificial Sequence: Synthetic spacer oligonucleotide
taaaaattgccacagatgaagagattaaacgg

SEQ ID NO: 1616 - DNA, 32 bp, Artificial Sequence
  Description of Artificial Sequence: Synthetic spacer oligonucleotide
cgatttgaaactgaatattcatgttatcccac

SEQ ID NO: 1617 - DNA, 32 bp, Artificial Sequence
  Description of Artificial Sequence: Synthetic spacer oligonucleotide
aatatgcagaatcaccaacaacgcgcgcgccc

SEQ ID NO: 1618 - DNA, 32 bp, Artificial Sequence
  Description of Artificial Sequence: Synthetic spacer oligonucleotide
gttgatcagtacctgcaagccgtggggattcg

SEQ ID NO: 1619 - DNA, 32 bp, Artificial Sequence
  Description of Artificial Sequence: Synthetic spacer oligonucleotide
ttcagtgcgttgaatagccgatacacggttgc

SEQ ID NO: 1620 - DNA, 32 bp, Artificial Sequence
  Description of Artificial Sequence: Synthetic spacer oligonucleotide
ctttactggagccatcggagcattagccagaa

SEQ ID NO: 1621 - DNA, 32 bp, Artificial Sequence
  Description of Artificial Sequence: Synthetic spacer oligonucleotide
tctttatatagcgcgctgtctaatattgttct

SEQ ID NO: 1622 - DNA, 32 bp, Artificial Sequence
  Description of Artificial Sequence: Synthetic spacer oligonucleotide
atgctatgtggtgaatgttgccagcaaagcgg

SEQ ID NO: 1623 - DNA, 32 bp, Artificial Sequence
  Description of Artificial Sequence: Synthetic spacer oligonucleotide
aagagactcagctatgggactaatggataaat

SEQ ID NO: 1624 - DNA, 32 bp, Artificial Sequence
  Description of Artificial Sequence: Synthetic spacer oligonucleotide
cagcacgaaatcgactataccgccgggcgtta

SEQ ID NO: 1625 - DNA, 32 bp, Artificial Sequence
  Description of Artificial Sequence: Synthetic spacer oligonucleotide
gtcactaaccagcctgaaatcagttttacagg

SEQ ID NO: 1626 - DNA, 32 bp, Artificial Sequence
  Description of Artificial Sequence: Synthetic spacer oligonucleotide
aaaacacacaatcgcagcctcatacagactgg

SEQ ID NO: 1627 - DNA, 32 bp, Artificial Sequence
  Description of Artificial Sequence: Synthetic spacer oligonucleotide
gtttgttttatcagtcggatcaagaggaaaat

SEQ ID NO: 1628 - DNA, 32 bp, Artificial Sequence
  Description of Artificial Sequence: Synthetic spacer oligonucleotide
aaatcgttattggccgcgttaaacatagttgc

SEQ ID NO: 1629 - DNA, 32 bp, Artificial Sequence
  Description of Artificial Sequence: Synthetic spacer oligonucleotide
cgaacggcacgcggccacggtggtgaggggcg

SEQ ID NO: 1630 - DNA, 32 bp, Artificial Sequence
  Description of Artificial Sequence: Synthetic spacer oligonucleotide
agattcacgttcgctgctgggcgctcatacgc

SEQ ID NO: 1631 - DNA, 32 bp, Artificial Sequence
  Description of Artificial Sequence: Synthetic spacer oligonucleotide
cacggtaaatactggtatacacgcgggaccag

SEQ ID NO: 1632 - DNA, 32 bp, Artificial Sequence
  Description of Artificial Sequence: Synthetic spacer oligonucleotide
aaaaattttctgtgaaatgccgggttgcgcgc

SEQ ID NO: 1633 - DNA, 50 bp, Artificial Sequence
  Description of Artificial Sequence: Synthetic spacer oligonucleotide
ctgatcgtcagttatgccggcgcggaatgatggacgagagagagcggaaa

SEQ ID NO: 1634 - DNA, 32 bp, Artificial Sequence
  Description of Artificial Sequence: Synthetic spacer oligonucleotide
ttccgggataattcccggtcattggcgttgac

SEQ ID NO: 1635 - DNA, 32 bp, Artificial Sequence
  Description of Artificial Sequence: Synthetic spacer oligonucleotide
gaaatagcaaacacgaacgactcgccgatccc

SEQ ID NO: 1636 - DNA, 32 bp, Artificial Sequence
  Description of Artificial Sequence: Synthetic spacer oligonucleotide
ggcatagcccccgattttcggcgtacccgtgc

SEQ ID NO: 1637 - DNA, 32 bp, Artificial Sequence
  Description of Artificial Sequence: Synthetic spacer oligonucleotide
ttcttatcggtgtggttcggtcgtaacgttga

SEQ ID NO: 1638 - DNA, 32 bp, Artificial Sequence
  Description of Artificial Sequence: Synthetic spacer oligonucleotide
taactcagccacgctaccgaacgtgcggcgcg

SEQ ID NO: 1639 - DNA, 32 bp, Artificial Sequence
  Description of Artificial Sequence: Synthetic spacer oligonucleotide
tcgtggggagtctgaggcatacggctgtacgc

SEQ ID NO: 1640 - DNA, 32 bp, Artificial Sequence
  Description of Artificial Sequence: Synthetic spacer oligonucleotide
gttgccgtagtacttcatcaaaaaggctctga

SEQ ID NO: 1641 - DNA, 32 bp, Artificial Sequence
  Description of Artificial Sequence: Synthetic spacer oligonucleotide
ttcgcgctgcggcttgccatgccgaaatactg

SEQ ID NO: 1642 - DNA, 32 bp, Artificial Sequence
  Description of Artificial Sequence: Synthetic spacer oligonucleotide
caaaataaaaatatttttagagctaatccccg

SEQ ID NO: 1643 - DNA, 32 bp, Artificial Sequence
  Description of Artificial Sequence: Synthetic spacer oligonucleotide
gagtcattaccggccatgataaccgccaagcg

SEQ ID NO: 1644 - DNA, 32 bp, Artificial Sequence
  Description of Artificial Sequence: Synthetic spacer oligonucleotide
gtcagcgtgttctttatttaaccccctgcacg

SEQ ID NO: 1645 - DNA, 32 bp, Artificial Sequence
  Description of Artificial Sequence: Synthetic spacer oligonucleotide
gcagatacggtaaacgactcaaaatacacgaa

SEQ ID NO: 1646 - DNA, 32 bp, Artificial Sequence
  Description of Artificial Sequence: Synthetic spacer oligonucleotide
acgtcgctttcgtatagcgataccattgccac

SEQ ID NO: 1647 - DNA, 32 bp, Artificial Sequence
  Description of Artificial Sequence: Synthetic spacer oligonucleotide
gtgctgggcattatccgcaggcgctaacccgt

SEQ ID NO: 1648 - DNA, 32 bp, Artificial Sequence
  Description of Artificial Sequence: Synthetic spacer oligonucleotide
acgaacaacagctcgctcacgaacaatgtccg

SEQ ID NO: 1649 - DNA, 32 bp, Artificial Sequence
  Description of Artificial Sequence: Synthetic spacer oligonucleotide
gttacgccgggccaggtgagagacgttacatc

SEQ ID NO: 1650 - DNA, 32 bp, Artificial Sequence
  Description of Artificial Sequence: Synthetic spacer oligonucleotide
ccgacgcgggggcgcgggtcgtcgtcctgctg

SEQ ID NO: 1651 - DNA, 32 bp, Artificial Sequence
  Description of Artificial Sequence: Synthetic spacer oligonucleotide
tctaatcgcttccggggttccctgaatttccg

SEQ ID NO: 1652 - DNA, 32 bp, Artificial Sequence
  Description of Artificial Sequence: Synthetic spacer oligonucleotide
gcgcatcccacagtaaaaactgtatatcggcc

SEQ ID NO: 1653 - DNA, 32 bp, Artificial Sequence
  Description of Artificial Sequence: Synthetic spacer oligonucleotide
aaagggagccaaatctgccgcatgaccatcgt

SEQ ID NO: 1654 - DNA, 33 bp, Artificial Sequence
  Description of Artificial Sequence: Synthetic spacer oligonucleotide
cgcgtaaattagacatttaaaacccccttatgc

SEQ ID NO: 1655 - DNA, 32 bp, Artificial Sequence
  Description of Artificial Sequence: Synthetic spacer oligonucleotide
aatatatttatcaccgaactccagaatatagg

SEQ ID NO: 1656 - DNA, 32 bp, Artificial Sequence
  Description of Artificial Sequence: Synthetic spacer oligonucleotide
ggccgacaacgccgattatttccgcagaatac

SEQ ID NO: 1657 - DNA, 32 bp, Artificial Sequence
  Description of Artificial Sequence: Synthetic spacer oligonucleotide
taagtcgctgggcataagcaagaacgcaattg

SEQ ID NO: 1658 - DNA, 32 bp, Artificial Sequence
  Description of Artificial Sequence: Synthetic spacer oligonucleotide
ccccggcaaccatccatttaatgagcgcatta

SEQ ID NO: 1659 - DNA, 32 bp, Artificial Sequence
  Description of Artificial Sequence: Synthetic spacer oligonucleotide
tcataatgaagccctatctcaacctgtttggc

SEQ ID NO: 1660 - DNA, 32 bp, Artificial Sequence
  Description of Artificial Sequence: Synthetic spacer oligonucleotide
gaacgtagccacggatatacgctgctgcctct

SEQ ID NO: 1661 - DNA, 32 bp, Artificial Sequence
  Description of Artificial Sequence: Synthetic spacer oligonucleotide
atccaggaatactcaaggatatgctgagaatt

SEQ ID NO: 1662 - DNA, 32 bp, Artificial Sequence
  Description of Artificial Sequence: Synthetic spacer oligonucleotide
attgtcgtcacaacaccagcagcgcccatcgc

SEQ ID NO: 1663 - DNA, 32 bp, Artificial Sequence
  Description of Artificial Sequence: Synthetic spacer oligonucleotide
cacatgatttatcccgatggttctccgattgg

SEQ ID NO: 1664 - DNA, 32 bp, Artificial Sequence
  Description of Artificial Sequence: Synthetic spacer oligonucleotide
ctgcccgtttaatgcgcgcattcgttccgcgt

SEQ ID NO: 1665 - DNA, 32 bp, Artificial Sequence
  Description of Artificial Sequence: Synthetic spacer oligonucleotide
cgccctcagccagcgagtaaaacttgattccg

SEQ ID NO: 1666 - DNA, 32 bp, Artificial Sequence
  Description of Artificial Sequence: Synthetic spacer oligonucleotide
tttgtacagattgagaaagaccccgcgtagtc

SEQ ID NO: 1667 - DNA, 32 bp, Artificial Sequence
  Description of Artificial Sequence: Synthetic spacer oligonucleotide
acggaccgcatcacgggctggcattgtgcagg

SEQ ID NO: 1668 - DNA, 32 bp, Artificial Sequence
  Description of Artificial Sequence: Synthetic spacer oligonucleotide
ggaaaccactgttcgtaaaacgtatatggtcc

SEQ ID NO: 1669 - DNA, 32 bp, Artificial Sequence
  Description of Artificial Sequence: Synthetic spacer oligonucleotide
gagccattcgctttcaattttcggtgtataac

SEQ ID NO: 1670 - DNA, 32 bp, Artificial Sequence
  Description of Artificial Sequence: Synthetic spacer oligonucleotide
tggaaaaggggtgaatatgtgacagcaattgg

SEQ ID NO: 1671 - DNA, 32 bp, Artificial Sequence
  Description of Artificial Sequence: Synthetic spacer oligonucleotide
acaattacataacaggtgtgacagacggcggg

SEQ ID NO: 1672 - DNA, 32 bp, Artificial Sequence
  Description of Artificial Sequence: Synthetic spacer oligonucleotide
tggtcgtgaccagcgggcgccgctgtgaggcc

SEQ ID NO: 1673 - DNA, 32 bp, Artificial Sequence
  Description of Artificial Sequence: Synthetic spacer oligonucleotide
atcgccacatgcgacgcctcttttttctgtac

SEQ ID NO: 1674 - DNA, 32 bp, Artificial Sequence
  Description of Artificial Sequence: Synthetic spacer oligonucleotide
ttctgtttcaccgtcacggcctcggccgggag

SEQ ID NO: 1675 - DNA, 32 bp, Artificial Sequence
  Description of Artificial Sequence: Synthetic spacer oligonucleotide
aattcatatagagccaatgtataattggcgtc

SEQ ID NO: 1676 - DNA, 32 bp, Artificial Sequence
  Description of Artificial Sequence: Synthetic spacer oligonucleotide
tgtccgcttttggggtgaacaatcgtgaccgg

SEQ ID NO: 1677 - DNA, 32 bp, Artificial Sequence
  Description of Artificial Sequence: Synthetic spacer oligonucleotide
ctggccataattgactgatatcgagctttggt

SEQ ID NO: 1678 - DNA, 32 bp, Artificial Sequence
  Description of Artificial Sequence: Synthetic spacer oligonucleotide
tttaaagagctggctgctgatgtggatcggat

SEQ ID NO: 1679 - DNA, 32 bp, Artificial Sequence
  Description of Artificial Sequence: Synthetic spacer oligonucleotide
tacgccgtcctgctccgcaagaaaaacaactc

SEQ ID NO: 1680 - DNA, 32 bp, Artificial Sequence
  Description of Artificial Sequence: Synthetic spacer oligonucleotide
gcgcttaaaccggtttttattaatgttgtttt

SEQ ID NO: 1681 - DNA, 32 bp, Artificial Sequence
  Description of Artificial Sequence: Synthetic spacer oligonucleotide
ggtcagaacagtgctctcaatcagtattacaa

SEQ ID NO: 1682 - DNA, 32 bp, Artificial Sequence
  Description of Artificial Sequence: Synthetic spacer oligonucleotide
aggtaaacgtgcgggttggtctgatccgtcag

SEQ ID NO: 1683 - DNA, 32 bp, Artificial Sequence
  Description of Artificial Sequence: Synthetic spacer oligonucleotide
tcaacgccagtaacctgcgttgcgctcgtcgc

SEQ ID NO: 1684 - DNA, 32 bp, Artificial Sequence
  Description of Artificial Sequence: Synthetic spacer oligonucleotide
cttttcagtaattgatttcgctattgtgtcaa

SEQ ID NO: 1685 - DNA, 32 bp, Artificial Sequence
  Description of Artificial Sequence: Synthetic spacer oligonucleotide
atcacgcgcaaaattcgcttgtcgattaactg

SEQ ID NO: 1686 - DNA, 32 bp, Artificial Sequence
  Description of Artificial Sequence: Synthetic spacer oligonucleotide
cggggcattagttcggctgatgttttatatag

SEQ ID NO: 1687 - DNA, 32 bp, Artificial Sequence
  Description of Artificial Sequence: Synthetic spacer oligonucleotide
tcgtgaacggtttcgccgtgatcgagtttgaa

SEQ ID NO: 1688 - DNA, 32 bp, Artificial Sequence
  Description of Artificial Sequence: Synthetic spacer oligonucleotide
caaaagaggcgacgggaaactctgaggccgtt

SEQ ID NO: 1689 - DNA, 32 bp, Artificial Sequence
  Description of Artificial Sequence: Synthetic spacer oligonucleotide
gaattcacccacttcctggaagaactgaccaa

SEQ ID NO: 1690 - DNA, 32 bp, Artificial Sequence
  Description of Artificial Sequence: Synthetic spacer oligonucleotide
tccgggaacgtttcggcgaacgtttctgggga

SEQ ID NO: 1691 - DNA, 32 bp, Artificial Sequence
  Description of Artificial Sequence: Synthetic spacer oligonucleotide
gacagattcatgatgcgctgcgctaacagccc

SEQ ID NO: 1692 - DNA, 32 bp, Artificial Sequence
  Description of Artificial Sequence: Synthetic spacer oligonucleotide
ctttcaacaatcaccgatccgtctggggtgtg

SEQ ID NO: 1693 - DNA, 69 bp, Artificial Sequence
  Description of Artificial Sequence: Synthetic spacer oligonucleotide
ggcgcggtagcacaacccacacaggggcacggcggtttatccccgccttaattgcagcctcacgggccg

SEQ ID NO: 1694 - DNA, 32 bp, Artificial Sequence
  Description of Artificial Sequence: Synthetic spacer oligonucleotide
gaaagaattggaatttgccattacgcagagtg

SEQ ID NO: 1695 - DNA, 32 bp, Artificial Sequence
  Description of Artificial Sequence: Synthetic spacer oligonucleotide
ctgctcgctagaccccaagacggttacatcaa

SEQ ID NO: 1696 - DNA, 32 bp, Artificial Sequence
  Description of Artificial Sequence: Synthetic spacer oligonucleotide
gttaccagaaccaagcacgctgttacccgtcc

SEQ ID NO: 1697 - DNA, 32 bp, Artificial Sequence
  Description of Artificial Sequence: Synthetic spacer oligonucleotide
tataaatatattgttggacggtaaaggcaacc

SEQ ID NO: 1698 - DNA, 32 bp, Artificial Sequence
  Description of Artificial Sequence: Synthetic spacer oligonucleotide
ggcctggctaacagcagcagcagcttttccgt

SEQ ID NO: 1699 - DNA, 32 bp, Artificial Sequence
  Description of Artificial Sequence: Synthetic spacer oligonucleotide
atcgccggggcgggcaatgacgccagctcacc

SEQ ID NO: 1700 - DNA, 32 bp, Artificial Sequence
  Description of Artificial Sequence: Synthetic spacer oligonucleotide
ctgcgcgacaacttcatcgaacaggtcacagg

SEQ ID NO: 1701 - DNA, 32 bp, Artificial Sequence
  Description of Artificial Sequence: Synthetic spacer oligonucleotide
cgctacgcagtccgcgagaatatcctgcgcac

SEQ ID NO: 1702 - DNA, 32 bp, Artificial Sequence
  Description of Artificial Sequence: Synthetic spacer oligonucleotide
tcgtcgaggcggatgaaatagtggttagcatc

SEQ ID NO: 1703 - DNA, 32 bp, Artificial Sequence
  Description of Artificial Sequence: Synthetic spacer oligonucleotide
agcgccagggaaccggttaaaccctgtgttgc

SEQ ID NO: 1704 - DNA, 32 bp, Artificial Sequence
  Description of Artificial Sequence: Synthetic spacer oligonucleotide
gttctcaggggttggattgttaacgctgccaa

SEQ ID NO: 1705 - DNA, 31 bp, Artificial Sequence
  Description of Artificial Sequence: Synthetic spacer oligonucleotide
ccccctgattattttttatccgtttcagtaa

SEQ ID NO: 1706 - DNA, 32 bp, Artificial Sequence
  Description of Artificial Sequence: Synthetic spacer oligonucleotide
ccgaaacccgctataacgaataacagtgctca

SEQ ID NO: 1707 - DNA, 32 bp, Artificial Sequence
  Description of Artificial Sequence: Synthetic spacer oligonucleotide
ccccgagctaccgccaggacttattgaagtga

SEQ ID NO: 1708 - DNA, 32 bp, Artificial Sequence
  Description of Artificial Sequence: Synthetic spacer oligonucleotide
gcaaacaaactgcggttttatggctcgctgaa

SEQ ID NO: 1709 - DNA, 32 bp, Artificial Sequence
  Description of Artificial Sequence: Synthetic spacer oligonucleotide
gttcatcacccacccggtgatcacacggacgc

SEQ ID NO: 1710 - DNA, 32 bp, Artificial Sequence
  Description of Artificial Sequence: Synthetic spacer oligonucleotide
ttttcccacattttttcgatgtcatgcgcggc

SEQ ID NO: 1711 - DNA, 32 bp, Artificial Sequence
  Description of Artificial Sequence: Synthetic spacer oligonucleotide
acaaacattgcagctacgttaattggatcaat

SEQ ID NO: 1712 - DNA, 32 bp, Artificial Sequence
  Description of Artificial Sequence: Synthetic spacer oligonucleotide
gcaaacgggctcattttccactgcgcggcctg

SEQ ID NO: 1713 - DNA, 32 bp, Artificial Sequence
  Description of Artificial Sequence: Synthetic spacer oligonucleotide
cttcatacgcttttcggtaaagatgcggagcc

SEQ ID NO: 1714 - DNA, 32 bp, Artificial Sequence
  Description of Artificial Sequence: Synthetic spacer oligonucleotide
cgcctgatatagatttctgtgaatgcctcatt

SEQ ID NO: 1715 - DNA, 33 bp, Artificial Sequence
  Description of Artificial Sequence: Synthetic spacer oligonucleotide
gtgttccgggcgtccgaatttctggatcacatc

SEQ ID NO: 1716 - DNA, 32 bp, Artificial Sequence
  Description of Artificial Sequence: Synthetic spacer oligonucleotide
aaaaccgacgcccaacgccacagggaacgagt

SEQ ID NO: 1717 - DNA, 32 bp, Artificial Sequence
  Description of Artificial Sequence: Synthetic spacer oligonucleotide
acacccggttgcgatcaatggtctgggggctg

SEQ ID NO: 1718 - DNA, 32 bp, Artificial Sequence
  Description of Artificial Sequence: Synthetic spacer oligonucleotide
ttttttcttcggcgcccaaccgcagcctaacg

SEQ ID NO: 1719 - DNA, 74 bp, Artificial Sequence
  Description of Artificial Sequence: Synthetic spacer oligonucleotide
gcattctgtcgttgccagctgaagaactggcgcggggaacacatgaagtccttatagtacatttcaaatactcc

SEQ ID NO: 1720 - DNA, 32 bp, Artificial Sequence
  Description of Artificial Sequence: Synthetic spacer oligonucleotide
agcaacggcaggatccccatcgggtcgtccgg

SEQ ID NO: 1721 - DNA, 32 bp, Artificial Sequence
  Description of Artificial Sequence: Synthetic spacer oligonucleotide
gaccgtgcgaatttcaaagcgcgttttcgccc

SEQ ID NO: 1722 - DNA, 32 bp, Artificial Sequence
  Description of Artificial Sequence: Synthetic spacer oligonucleotide
gccgagcatatcgagctcacgggcgcgggttt

SEQ ID NO: 1723 - DNA, 32 bp, Artificial Sequence
  Description of Artificial Sequence: Synthetic spacer oligonucleotide
gtgccagttctctggttgacgatcgggaatgc

SEQ ID NO: 1724 - DNA, 32 bp, Artificial Sequence
  Description of Artificial Sequence: Synthetic spacer oligonucleotide
gaaatttccaccgtggatatttcggttattgg

SEQ ID NO: 1725 - DNA, 32 bp, Artificial Sequence
  Description of Artificial Sequence: Synthetic spacer oligonucleotide
tttctcgacctcgtcgccgtaacgttcggccg

SEQ ID NO: 1726 - DNA, 32 bp, Artificial Sequence
  Description of Artificial Sequence: Synthetic spacer oligonucleotide
tgctgccgtggaagagtttcatttgataaatc

SEQ ID NO: 1727 - DNA, 32 bp, Artificial Sequence
  Description of Artificial Sequence: Synthetic spacer oligonucleotide
tccaccagattttcaaaatcacgcagggcgcg

SEQ ID NO: 1728 - DNA, 32 bp, Artificial Sequence
  Description of Artificial Sequence: Synthetic spacer oligonucleotide
gtgattagccagtctttagaggacataatccc

SEQ ID NO: 1729 - DNA, 32 bp, Artificial Sequence
  Description of Artificial Sequence: Synthetic spacer oligonucleotide
tcaccgccacgcgggccgctattgagcgaatg

SEQ ID NO: 1730 - DNA, 32 bp, Artificial Sequence
  Description of Artificial Sequence: Synthetic spacer oligonucleotide
aactcaatgcgctggtttaatctttcgttagt

SEQ ID NO: 1731 - DNA, 32 bp, Artificial Sequence
  Description of Artificial Sequence: Synthetic spacer oligonucleotide
acgatgaggaggacgaaccgcaatttttcact

SEQ ID NO: 1732 - DNA, 32 bp, Artificial Sequence
  Description of Artificial Sequence: Synthetic spacer oligonucleotide
gcgtagcgttcagcgaggcggttatcaccccc

SEQ ID NO: 1733 - DNA, 32 bp, Artificial Sequence
  Description of Artificial Sequence: Synthetic spacer oligonucleotide
aaacgcggctccccgtctttaggctccggcca

SEQ ID NO: 1734 - DNA, 32 bp, Artificial Sequence
  Description of Artificial Sequence: Synthetic spacer oligonucleotide
cagctcaatacggacgtagttcagcaaattat

SEQ ID NO: 1735 - DNA, 32 bp, Artificial Sequence
  Description of Artificial Sequence: Synthetic spacer oligonucleotide
ggatggcgcgccaataattttattgacgattt

SEQ ID NO: 1736 - DNA, 32 bp, Artificial Sequence
  Description of Artificial Sequence: Synthetic spacer oligonucleotide
atttgaacgcacatcaacatgcgtaaaagatg

SEQ ID NO: 1737 - DNA, 32 bp, Artificial Sequence
  Description of Artificial Sequence: Synthetic spacer oligonucleotide
aggctacccaacgcccccacgctacaggctgg

SEQ ID NO: 1738 - DNA, 32 bp, Artificial Sequence
  Description of Artificial Sequence: Synthetic spacer oligonucleotide
ttccggagtgactggtatcgcgacgtattcaa

SEQ ID NO: 1739 - DNA, 32 bp, Artificial Sequence
  Description of Artificial Sequence: Synthetic spacer oligonucleotide
atttggacgttaaaggatcggcaatgacgacg

SEQ ID NO: 1740 - DNA, 32 bp, Artificial Sequence
  Description of Artificial Sequence: Synthetic spacer oligonucleotide
atagagcacatagaccaggttggcgagtcgga

SEQ ID NO: 1741 - DNA, 32 bp, Artificial Sequence
  Description of Artificial Sequence: Synthetic spacer oligonucleotide
ggcgccatgctgttcgcgctggaggcaaaaat

SEQ ID NO: 1742 - DNA, 32 bp, Artificial Sequence
  Description of Artificial Sequence: Synthetic spacer oligonucleotide
ccatcccgaatagctggactgtagatcgtgcg

SEQ ID NO: 1743 - DNA, 32 bp, Artificial Sequence
  Description of Artificial Sequence: Synthetic spacer oligonucleotide
tcatatgttttcgccgttaccgccttataacg

SEQ ID NO: 1744 - DNA, 32 bp, Artificial Sequence
  Description of Artificial Sequence: Synthetic spacer oligonucleotide
ctttcttgaactcttcaaagtcgagccattcg

SEQ ID NO: 1745 - DNA, 32 bp, Artificial Sequence
  Description of Artificial Sequence: Synthetic spacer oligonucleotide
cgtagtcagtgagagaaatattaacaagcccc

SEQ ID NO: 1746 - DNA, 32 bp, Artificial Sequence
  Description of Artificial Sequence: Synthetic spacer oligonucleotide
gccacccggacaacaaaatgtatcccgattat

SEQ ID NO: 1747 - DNA, 32 bp, Artificial Sequence
  Description of Artificial Sequence: Synthetic spacer oligonucleotide
tagcgaataatgattgtgtttaagtggatact

SEQ ID NO: 1748 - DNA, 32 bp, Artificial Sequence
  Description of Artificial Sequence: Synthetic spacer oligonucleotide
gagggtctggaagcactaccagaagcggagca

SEQ ID NO: 1749 - DNA, 32 bp, Artificial Sequence
  Description of Artificial Sequence: Synthetic spacer oligonucleotide
cgtcaaaactgtacgagccgtccatgcccgta

SEQ ID NO: 1750 - DNA, 32 bp, Artificial Sequence
  Description of Artificial Sequence: Synthetic spacer oligonucleotide
tgccgggtctatgcgagagataataaagtaac

SEQ ID NO: 1751 - DNA, 32 bp, Artificial Sequence
  Description of Artificial Sequence: Synthetic spacer oligonucleotide
ataattaagtaaatattaccctgttaaaacgt

SEQ ID NO: 1752 - DNA, 32 bp, Artificial Sequence
  Description of Artificial Sequence: Synthetic spacer oligonucleotide
accggaatgccatccgatccaacctgacggac

SEQ ID NO: 1753 - DNA, 32 bp, Artificial Sequence
  Description of Artificial Sequence: Synthetic spacer oligonucleotide
tctccagactgatcctcaacaacacacgccgg

SEQ ID NO: 1754 - DNA, 32 bp, Artificial Sequence
  Description of Artificial Sequence: Synthetic spacer oligonucleotide
agttcattggttctatataaatcatattctgc

SEQ ID NO: 1755 - DNA, 32 bp, Artificial Sequence
  Description of Artificial Sequence: Synthetic spacer oligonucleotide
atccagtagacgcagaaaatcagcaggaagca

SEQ ID NO: 1756 - DNA, 32 bp, Artificial Sequence
  Description of Artificial Sequence: Synthetic spacer oligonucleotide
gatattgcgccgagccgagaaacgcgggcgcc

SEQ ID NO: 1757 - DNA, 32 bp, Artificial Sequence
  Description of Artificial Sequence: Synthetic spacer oligonucleotide
gcaaatatggctgggtgaagacaaaattgagg

SEQ ID NO: 1758 - DNA, 32 bp, Artificial Sequence
  Description of Artificial Sequence: Synthetic spacer oligonucleotide
agtcctgtaagtttttttcttagccatggtta

SEQ ID NO: 1759 - DNA, 32 bp, Artificial Sequence
  Description of Artificial Sequence: Synthetic spacer oligonucleotide
cggtagaaactcaaaactatggcaccagcctg

SEQ ID NO: 1760 - DNA, 32 bp, Artificial Sequence
  Description of Artificial Sequence: Synthetic spacer oligonucleotide
gtccgtggtgtcaatctgcggcacgcgctgga

SEQ ID NO: 1761 - DNA, 32 bp, Artificial Sequence
  Description of Artificial Sequence: Synthetic spacer oligonucleotide
gggcaatatgctctgggtcgccataattaccc

SEQ ID NO: 1762 - DNA, 32 bp, Artificial Sequence
  Description of Artificial Sequence: Synthetic spacer oligonucleotide
atctcggtgcgacggcctgatttagagttaaa

SEQ ID NO: 1763 - DNA, 32 bp, Artificial Sequence
  Description of Artificial Sequence: Synthetic spacer oligonucleotide
aagtgctggatattaattccctcgataactcc

SEQ ID NO: 1764 - DNA, 32 bp, Artificial Sequence
  Description of Artificial Sequence: Synthetic spacer oligonucleotide
tttgccatcatcgaccaaatcatcacccagat

SEQ ID NO: 1765 - DNA, 32 bp, Artificial Sequence
  Description of Artificial Sequence: Synthetic spacer oligonucleotide
tatatagcgctggtcaggcgcatggtctcttg

SEQ ID NO: 1766 - DNA, 32 bp, Artificial Sequence
  Description of Artificial Sequence: Synthetic spacer oligonucleotide
aatgaaataccagaacgagaaatagcggcttt

SEQ ID NO: 1767 - DNA, 32 bp, Artificial Sequence
  Description of Artificial Sequence: Synthetic spacer oligonucleotide
agcgaccgacacgtctttcccgtcggcagcgt

SEQ ID NO: 1768 - DNA, 32 bp, Artificial Sequence
  Description of Artificial Sequence: Synthetic spacer oligonucleotide
tctgcgatagccgcaacagcatcaaccgcata

SEQ ID NO: 1769 - DNA, 32 bp, Artificial Sequence
  Description of Artificial Sequence: Synthetic spacer oligonucleotide
ttgacggggggcgcgggggtgataagcccccg

SEQ ID NO: 1770 - DNA, 32 bp, Artificial Sequence
  Description of Artificial Sequence: Synthetic spacer oligonucleotide
tgactaacctactttacgtagtattctctact

SEQ ID NO: 1771 - DNA, 32 bp, Artificial Sequence
  Description of Artificial Sequence: Synthetic spacer oligonucleotide
atttccccaattcatcacaatcagatccctgt

SEQ ID NO: 1772 - DNA, 32 bp, Artificial Sequence
  Description of Artificial Sequence: Synthetic spacer oligonucleotide
gcaggatgatccggtgaaattccggttgtcag

SEQ ID NO: 1773 - DNA, 32 bp, Artificial Sequence
  Description of Artificial Sequence: Synthetic spacer oligonucleotide
agcccgccgccgcgcagaaagccagccgcgac

SEQ ID NO: 1774 - DNA, 33 bp, Artificial Sequence
  Description of Artificial Sequence: Synthetic spacer oligonucleotide
gaaaaaatgtcaacgctatggcgcaggccaaac

SEQ ID NO: 1775 - DNA, 32 bp, Artificial Sequence
  Description of Artificial Sequence: Synthetic spacer oligonucleotide
taatttccgtcacatcgggttcggccgcagag

SEQ ID NO: 1776 - DNA, 32 bp, Artificial Sequence
  Description of Artificial Sequence: Synthetic spacer oligonucleotide
gtctccgcaaaggaagcagagctgttctgcgg

SEQ ID NO: 1777 - DNA, 32 bp, Artificial Sequence
  Description of Artificial Sequence: Synthetic spacer oligonucleotide
tcccaatgactcaatttcatcatagagactgt

SEQ ID NO: 1778 - DNA, 32 bp, Artificial Sequence
  Description of Artificial Sequence: Synthetic spacer oligonucleotide
ctttcgggttgaaagcagtagcactcatgccc

SEQ ID NO: 1779 - DNA, 32 bp, Artificial Sequence
  Description of Artificial Sequence: Synthetic spacer oligonucleotide
cgtttcccgatccagcgcatgactggtacggc

SEQ ID NO: 1780 - DNA, 33 bp, Artificial Sequence
  Description of Artificial Sequence: Synthetic spacer oligonucleotide
gtgtccgtggaaacgtaacggcgctatgtcagg

SEQ ID NO: 1781 - DNA, 33 bp, Artificial Sequence
  Description of Artificial Sequence: Synthetic spacer oligonucleotide
gccggatacccgcgcgttgccgtatacccgcgc

SEQ ID NO: 1782 - DNA, 32 bp, Artificial Sequence
  Description of Artificial Sequence: Synthetic spacer oligonucleotide
gcgtaacggttgaggccggtgcggctcagctg

SEQ ID NO: 1783 - DNA, 32 bp, Artificial Sequence
  Description of Artificial Sequence: Synthetic spacer oligonucleotide
gacggactggaaaaactcatcatttctgaaga

SEQ ID NO: 1784 - DNA, 32 bp, Artificial Sequence
  Description of Artificial Sequence: Synthetic spacer oligonucleotide
gcgcttggcgtgtctcaaccgtcagtcgtgcg

SEQ ID NO: 1785 - DNA, 32 bp, Artificial Sequence
  Description of Artificial Sequence: Synthetic spacer oligonucleotide
gtctttaacggggatgtattgcggggttttct

SEQ ID NO: 1786 - DNA, 32 bp, Artificial Sequence
  Description of Artificial Sequence: Synthetic spacer oligonucleotide
caataatgattcgtggccgagattaaaagagg

SEQ ID NO: 1787 - DNA, 32 bp, Artificial Sequence
  Description of Artificial Sequence: Synthetic spacer oligonucleotide
agtttttgcgaccgcctcaatagctgaaagaa

SEQ ID NO: 1788 - DNA, 32 bp, Artificial Sequence
  Description of Artificial Sequence: Synthetic spacer oligonucleotide
atgatggcccctgttcagaaaacacaatcccg

SEQ ID NO: 1789 - DNA, 32 bp, Artificial Sequence
  Description of Artificial Sequence: Synthetic spacer oligonucleotide
ttacggccgaaccacacagacaagaaaaacgc

SEQ ID NO: 1790 - DNA, 32 bp, Artificial Sequence
  Description of Artificial Sequence: Synthetic spacer oligonucleotide
gtacttgaacagtttgcagctcagcaagaggc

SEQ ID NO: 1791 - DNA, 32 bp, Artificial Sequence
  Description of Artificial Sequence: Synthetic spacer oligonucleotide
atcattactaatacattgatattcgatataga

SEQ ID NO: 1792 - DNA, 32 bp, Artificial Sequence
  Description of Artificial Sequence: Synthetic spacer oligonucleotide
accgcccgcccgaccagcctgccacctgcccg

SEQ ID NO: 1793 - DNA, 32 bp, Artificial Sequence
  Description of Artificial Sequence: Synthetic spacer oligonucleotide
agttgcccgggccgattgagatccacagtctg

SEQ ID NO: 1794 - DNA, 32 bp, Artificial Sequence
  Description of Artificial Sequence: Synthetic spacer oligonucleotide
aagtccccgacgttctcgccgttgagtccggc

SEQ ID NO: 1795 - DNA, 32 bp, Artificial Sequence
  Description of Artificial Sequence: Synthetic spacer oligonucleotide
gtttttcggtccgcctctccctggaataatca

SEQ ID NO: 1796 - DNA, 32 bp, Artificial Sequence
  Description of Artificial Sequence: Synthetic spacer oligonucleotide
tgcagtcgcggcgaccagcacctttaccatct

SEQ ID NO: 1797 - DNA, 32 bp, Artificial Sequence
  Description of Artificial Sequence: Synthetic spacer oligonucleotide
ggagacctgtttcactgtacatgcaaacagtg

SEQ ID NO: 1798 - DNA, 32 bp, Artificial Sequence
  Description of Artificial Sequence: Synthetic spacer oligonucleotide
agaccaatagccagctcgctggcggtataagt

SEQ ID NO: 1799 - DNA, 32 bp, Artificial Sequence
  Description of Artificial Sequence: Synthetic spacer oligonucleotide
ggcgattgctgcacgggcacgatcccaagcgt

SEQ ID NO: 1800 - DNA, 32 bp, Artificial Sequence
  Description of Artificial Sequence: Synthetic spacer oligonucleotide
gttaccgttggcgtaacgcggaattgttggta

SEQ ID NO: 1801 - DNA, 32 bp, Artificial Sequence
  Description of Artificial Sequence: Synthetic spacer oligonucleotide
tcggcaacggatgcgaccgccagcgcgatccc

SEQ ID NO: 1802 - DNA, 32 bp, Artificial Sequence
  Description of Artificial Sequence: Synthetic spacer oligonucleotide
acagccacagaaaatgatcgcggatcggtctg

SEQ ID NO: 1803 - DNA, 32 bp, Artificial Sequence
  Description of Artificial Sequence: Synthetic spacer oligonucleotide
cggcatggtctgcatcgcgtacaatgcgcccg

SEQ ID NO: 1804 - DNA, 32 bp, Artificial Sequence
  Description of Artificial Sequence: Synthetic spacer oligonucleotide
tgtgaaagcgctaaccggatatctcctttgtc

SEQ ID NO: 1805 - DNA, 32 bp, Artificial Sequence
  Description of Artificial Sequence: Synthetic spacer oligonucleotide
atagtagctataaccactcccagagcgataaa

SEQ ID NO: 1806 - DNA, 32 bp, Artificial Sequence
  Description of Artificial Sequence: Synthetic spacer oligonucleotide
atatcagcaccgaatgacgccatgacttttgc

SEQ ID NO: 1807 - DNA, 32 bp, Artificial Sequence
  Description of Artificial Sequence: Synthetic spacer oligonucleotide
tacaatgtcgtcactgagtgtgcaaaaagtga

SEQ ID NO: 1808 - DNA, 32 bp, Artificial Sequence
  Description of Artificial Sequence: Synthetic spacer oligonucleotide
ccctggaccgctgctttaatcacatgttgcaa

SEQ ID NO: 1809 - DNA, 32 bp, Artificial Sequence
  Description of Artificial Sequence: Synthetic spacer oligonucleotide
acaatatttgcaacgacccgacgagataactc

SEQ ID NO: 1810 - DNA, 32 bp, Artificial Sequence
  Description of Artificial Sequence: Synthetic spacer oligonucleotide
gcggacgccggaccactggacaacaacctcgc

SEQ ID NO: 1811 - DNA, 32 bp, Artificial Sequence
  Description of Artificial Sequence: Synthetic spacer oligonucleotide
tgcatctgctgcttctggcgtcaaataatcgt

SEQ ID NO: 1812 - DNA, 32 bp, Artificial Sequence
  Description of Artificial Sequence: Synthetic spacer oligonucleotide
atgttgggtactcatctgctaaaaatgcacgg

SEQ ID NO: 1813 - DNA, 32 bp, Artificial Sequence
  Description of Artificial Sequence: Synthetic spacer oligonucleotide
tcaccatgttgtcgatgatgcgattctcctgc

SEQ ID NO: 1814 - DNA, 32 bp, Artificial Sequence
  Description of Artificial Sequence: Synthetic spacer oligonucleotide
tcagttagtgaatcgtagtttataaaatcctg

SEQ ID NO: 1815 - DNA, 32 bp, Artificial Sequence
  Description of Artificial Sequence: Synthetic spacer oligonucleotide
ggttagccaccggatcggtattctccgcaaag

SEQ ID NO: 1816 - DNA, 32 bp, Artificial Sequence
  Description of Artificial Sequence: Synthetic spacer oligonucleotide
gtcgtgccaaacctcgtatttttgatctttag

SEQ ID NO: 1817 - DNA, 32 bp, Artificial Sequence
  Description of Artificial Sequence: Synthetic spacer oligonucleotide
cttttctcgtagatagtaatacctgtcgtaaa

SEQ ID NO: 1818 - DNA, 32 bp, Artificial Sequence
  Description of Artificial Sequence: Synthetic spacer oligonucleotide
ttgacacgagtcccagagggcgcaggcgcgcc

SEQ ID NO: 1819 - DNA, 32 bp, Artificial Sequence
  Description of Artificial Sequence: Synthetic spacer oligonucleotide
tacaagttgccgatactctgctcagttgatga

SEQ ID NO: 1820 - DNA, 32 bp, Artificial Sequence
  Description of Artificial Sequence: Synthetic spacer oligonucleotide
aaatgtcgaccctctttaaccggttgaatact

SEQ ID NO: 1821 - DNA, 32 bp, Artificial Sequence
  Description of Artificial Sequence: Synthetic spacer oligonucleotide
gtgtgacggtttcgaccacaggggaaaattaa

SEQ ID NO: 1822 - DNA, 32 bp, Artificial Sequence
  Description of Artificial Sequence: Synthetic spacer oligonucleotide
tatttttcggtacttcaacgtcatcgttctgg

SEQ ID NO: 1823 - DNA, 32 bp, Artificial Sequence
  Description of Artificial Sequence: Synthetic spacer oligonucleotide
ggcagaacgttaatgccgcggcttaccaggta

SEQ ID NO: 1824 - DNA, 32 bp, Artificial Sequence
  Description of Artificial Sequence: Synthetic spacer oligonucleotide
gcccaatccatacgggacggttttaacaatgt

SEQ ID NO: 1825 - DNA, 32 bp, Artificial Sequence
  Description of Artificial Sequence: Synthetic spacer oligonucleotide
tcagcgaccggcagttcctgcacctggtcagt

SEQ ID NO: 1826 - DNA, 32 bp, Artificial Sequence
  Description of Artificial Sequence: Synthetic spacer oligonucleotide
acaatcttgacaaaattaatcaatacaaatcg

SEQ ID NO: 1827 - DNA, 32 bp, Artificial Sequence
  Description of Artificial Sequence: Synthetic spacer oligonucleotide
gatatcgagtatccaggaaataatttgccagg

SEQ ID NO: 1828 - DNA, 32 bp, Artificial Sequence
  Description of Artificial Sequence: Synthetic spacer oligonucleotide
tttactccgggcataaaaaaatccctcgcggg

SEQ ID NO: 1829 - DNA, 32 bp, Artificial Sequence
  Description of Artificial Sequence: Synthetic spacer oligonucleotide
atcgtcgtgaggaatattactgcgacaaatgc

SEQ ID NO: 1830 - DNA, 32 bp, Artificial Sequence
  Description of Artificial Sequence: Synthetic spacer oligonucleotide
tacgactttaactttggtatggggatggctaa

SEQ ID NO: 1831 - DNA, 32 bp, Artificial Sequence
  Description of Artificial Sequence: Synthetic spacer oligonucleotide
tcagaaagcggaatcacagggcaatcaggtta

SEQ ID NO: 1832 - DNA, 32 bp, Artificial Sequence
  Description of Artificial Sequence: Synthetic spacer oligonucleotide
tgcggcagggttcacgccgacgtaccaggacg

SEQ ID NO: 1833 - DNA, 32 bp, Artificial Sequence
  Description of Artificial Sequence: Synthetic spacer oligonucleotide
gttctcaaggaatgactggacgttaaagaaag

SEQ ID NO: 1834 - DNA, 32 bp, Artificial Sequence
  Description of Artificial Sequence: Synthetic spacer oligonucleotide
ttcggcgtagcccggcaggtgcgaagcagctg

SEQ ID NO: 1835 - DNA, 32 bp, Artificial Sequence
  Description of Artificial Sequence: Synthetic spacer oligonucleotide
tgatcaggattgctgacaacgaataccgtaaa

SEQ ID NO: 1836 - DNA, 32 bp, Artificial Sequence
  Description of Artificial Sequence: Synthetic spacer oligonucleotide
aactagcggaacatttacaggagaggtacagg

SEQ ID NO: 1837 - DNA, 29 bp, Artificial Sequence
  Description of Artificial Sequence: Synthetic spacer oligonucleotide
ttgagaatgcctatgaaatgggcgaccag

SEQ ID NO: 1838 - DNA, 32 bp, Artificial Sequence
  Description of Artificial Sequence: Synthetic spacer oligonucleotide
ttgcacatttattgacttgaatcacattttaa

SEQ ID NO: 1839 - DNA, 32 bp, Artificial Sequence
  Description of Artificial Sequence: Synthetic spacer oligonucleotide
aataagttaaaatctgttaattaaaaataacg

SEQ ID NO: 1840 - DNA, 32 bp, Artificial Sequence
  Description of Artificial Sequence: Synthetic spacer oligonucleotide
gcggcgactatatgacgcagcgcgaccgtctg

SEQ ID NO: 1841 - DNA, 32 bp, Artificial Sequence
  Description of Artificial Sequence: Synthetic spacer oligonucleotide
aatgcgtccaatacgagccgagtgcgcacgcc

SEQ ID NO: 1842 - DNA, 32 bp, Artificial Sequence
  Description of Artificial Sequence: Synthetic spacer oligonucleotide
tgaaccagacgaaccaggtaaacttttttccc

SEQ ID NO: 1843 - DNA, 32 bp, Artificial Sequence
  Description of Artificial Sequence: Synthetic spacer oligonucleotide
atgaggttaattggaattcgccctctctggtc

SEQ ID NO: 1844 - DNA, 32 bp, Artificial Sequence
  Description of Artificial Sequence: Synthetic spacer oligonucleotide
gtcgtgtgaaggggttaacgcgctgactgagt

SEQ ID NO: 1845 - DNA, 32 bp, Artificial Sequence
  Description of Artificial Sequence: Synthetic spacer oligonucleotide
caacctgttccccaaatagaattgcaggtctg

SEQ ID NO: 1846 - DNA, 32 bp, Artificial Sequence
  Description of Artificial Sequence: Synthetic spacer oligonucleotide
gcacgtctaacccggagaaacgccgcaccgaa

SEQ ID NO: 1847 - DNA, 32 bp, Artificial Sequence
  Description of Artificial Sequence: Synthetic spacer oligonucleotide
aaattttgataatcgctaatccaggatagccc

SEQ ID NO: 1848 - DNA, 32 bp, Artificial Sequence
  Description of Artificial Sequence: Synthetic spacer oligonucleotide
gggtacgtatcgcggcatatcgcaaatcgacc

SEQ ID NO: 1849 - DNA, 32 bp, Artificial Sequence
  Description of Artificial Sequence: Synthetic spacer oligonucleotide
gaccccgttcccgatgtagtcgttatggtcaa

SEQ ID NO: 1850 - DNA, 34 bp, Artificial Sequence
  Description of Artificial Sequence: Synthetic spacer oligonucleotide
ccggggagaaaagacgatgacaactcatgagctg

SEQ ID NO: 1851 - DNA, 32 bp, Artificial Sequence
  Description of Artificial Sequence: Synthetic spacer oligonucleotide
cacaatgtcagaggttattttcaaggcggagc

SEQ ID NO: 1852 - DNA, 32 bp, Artificial Sequence
  Description of Artificial Sequence: Synthetic spacer oligonucleotide
agcaagggataacgctggaaacagccgaaaaa

SEQ ID NO: 1853 - DNA, 32 bp, Artificial Sequence
  Description of Artificial Sequence: Synthetic spacer oligonucleotide
caccccagcgaataaaaatttacacgccacga

SEQ ID NO: 1854 - DNA, 32 bp, Artificial Sequence
  Description of Artificial Sequence: Synthetic spacer oligonucleotide
taactcatcacgtcagcgtcagaacccgcgac

SEQ ID NO: 1855 - DNA, 33 bp, Artificial Sequence
  Description of Artificial Sequence: Synthetic spacer oligonucleotide
gccatattttatccctgaaattatttatgccgc

SEQ ID NO: 1856 - DNA, 32 bp, Artificial Sequence
  Description of Artificial Sequence: Synthetic spacer oligonucleotide
cgaaatacccccgcgcgatcagtttgaattgc

SEQ ID NO: 1857 - DNA, 32 bp, Artificial Sequence
  Description of Artificial Sequence: Synthetic spacer oligonucleotide
ttgctcctccgtgagtggctctccggaaactg

SEQ ID NO: 1858 - DNA, 32 bp, Artificial Sequence
  Description of Artificial Sequence: Synthetic spacer oligonucleotide
cgctatttgctgaacctaagtcacttctgttt

SEQ ID NO: 1859 - DNA, 32 bp, Artificial Sequence
  Description of Artificial Sequence: Synthetic spacer oligonucleotide
ttagcctattattccacagttctataatctct

SEQ ID NO: 1860 - DNA, 32 bp, Artificial Sequence
  Description of Artificial Sequence: Synthetic spacer oligonucleotide
gacaaccttcaggccgtcatggtcaaagaagg

SEQ ID NO: 1861 - DNA, 32 bp, Artificial Sequence
  Description of Artificial Sequence: Synthetic spacer oligonucleotide
tcgcgttgggggatttgcttacctcgcggagc

SEQ ID NO: 1862 - DNA, 32 bp, Artificial Sequence
  Description of Artificial Sequence: Synthetic spacer oligonucleotide
atcccgggatacttaaagatatgcagagaatt

SEQ ID NO: 1863 - DNA, 32 bp, Artificial Sequence
  Description of Artificial Sequence: Synthetic spacer oligonucleotide
acgccctcacggatcatcattgtgaacgtgcg

SEQ ID NO: 1864 - DNA, 32 bp, Artificial Sequence
  Description of Artificial Sequence: Synthetic spacer oligonucleotide
tggccgcttgcccgctgattgccggatcgttt

SEQ ID NO: 1865 - DNA, 32 bp, Artificial Sequence
  Description of Artificial Sequence: Synthetic spacer oligonucleotide
ggctatatgtggtttggcgcaatagtggcggc

SEQ ID NO: 1866 - DNA, 32 bp, Artificial Sequence
  Description of Artificial Sequence: Synthetic spacer oligonucleotide
gcgctctcctctgactctttgttgccgttctc

SEQ ID NO: 1867 - DNA, 32 bp, Artificial Sequence
  Description of Artificial Sequence: Synthetic spacer oligonucleotide
atggactgacccataaaaactttttcatcttg

SEQ ID NO: 1868 - DNA, 32 bp, Artificial Sequence
  Description of Artificial Sequence: Synthetic spacer oligonucleotide
atctccgggttcggctgcggcctcaagcgcct

SEQ ID NO: 1869 - DNA, 32 bp, Artificial Sequence
  Description of Artificial Sequence: Synthetic spacer oligonucleotide
acccgaaactacctcattaccgaaacatcccc

SEQ ID NO: 1870 - DNA, 32 bp, Artificial Sequence
  Description of Artificial Sequence: Synthetic spacer oligonucleotide
agataaacccgaatctggccggtggcattttt

SEQ ID NO: 1871 - DNA, 32 bp, Artificial Sequence
  Description of Artificial Sequence: Synthetic spacer oligonucleotide
tggctgtattgattcaacaggggcagtgacaa

SEQ ID NO: 1872 - DNA, 32 bp, Artificial Sequence
  Description of Artificial Sequence: Synthetic spacer oligonucleotide
gccctgtgtttgttccagctcataaaatttcc

SEQ ID NO: 1873 - DNA, 32 bp, Artificial Sequence
  Description of Artificial Sequence: Synthetic spacer oligonucleotide
tcagcaagccacctttccccgtccggtaaaat

SEQ ID NO: 1874 - DNA, 32 bp, Artificial Sequence
  Description of Artificial Sequence: Synthetic spacer oligonucleotide
agagccagagtcaatgaatgaatcggcataat

SEQ ID NO: 1875 - DNA, 32 bp, Artificial Sequence
  Description of Artificial Sequence: Synthetic spacer oligonucleotide
gaattattcttcctgtacgactcttacatgtt

SEQ ID NO: 1876 - DNA, 32 bp, Artificial Sequence
  Description of Artificial Sequence: Synthetic spacer oligonucleotide
gggtatatgaagtactgaatggtaaacgtagc

SEQ ID NO: 1877 - DNA, 32 bp, Artificial Sequence
  Description of Artificial Sequence: Synthetic spacer oligonucleotide
tttataatgacatcccaatctgggactaaata

SEQ ID NO: 1878 - DNA, 32 bp, Artificial Sequence
  Description of Artificial Sequence: Synthetic spacer oligonucleotide
agaaccggcagcggtcaaagcgaaaatgaaaa

SEQ ID NO: 1879 - DNA, 32 bp, Artificial Sequence
  Description of Artificial Sequence: Synthetic spacer oligonucleotide
ctcaagcgccccagtatacagctcgaaaatct

SEQ ID NO: 1880 - DNA, 32 bp, Artificial Sequence
  Description of Artificial Sequence: Synthetic spacer oligonucleotide
tttctcttgcattttctggttagtcatcttaa

SEQ ID NO: 1881 - DNA, 32 bp, Artificial Sequence
  Description of Artificial Sequence: Synthetic spacer oligonucleotide
tcgccgttcgtgcgcggcactgactgcaacag

SEQ ID NO: 1882 - DNA, 32 bp, Artificial Sequence
  Description of Artificial Sequence: Synthetic spacer oligonucleotide
cgtgaaaaacacgtggagccgtaaaaccatgc

SEQ ID NO: 1883 - DNA, 32 bp, Artificial Sequence
  Description of Artificial Sequence: Synthetic spacer oligonucleotide
gtggacatatcaagtatgtcctgccccatctg

SEQ ID NO: 1884 - DNA, 32 bp, Artificial Sequence
  Description of Artificial Sequence: Synthetic spacer oligonucleotide
ctcccacaggttgccgcccagccgctgacagg

SEQ ID NO: 1885 - DNA, 32 bp, Artificial Sequence
  Description of Artificial Sequence: Synthetic spacer oligonucleotide
aaaaattttacggttaacaatcgtaaatacag

SEQ ID NO: 1886 - DNA, 32 bp, Artificial Sequence
  Description of Artificial Sequence: Synthetic spacer oligonucleotide
caggacaaattcaacctgctcgtttgtcagcc

SEQ ID NO: 1887 - DNA, 32 bp, Artificial Sequence
  Description of Artificial Sequence: Synthetic spacer oligonucleotide
accctgccgtatcgtacgaatcagatgatgca

SEQ ID NO: 1888 - DNA, 32 bp, Artificial Sequence
  Description of Artificial Sequence: Synthetic spacer oligonucleotide
agccgctggtgtggcgggacaagaaaaatctc

SEQ ID NO: 1889 - DNA, 32 bp, Artificial Sequence
  Description of Artificial Sequence: Synthetic spacer oligonucleotide
ggcagcacagcataaggaatgctggtttcaac

SEQ ID NO: 1890 - DNA, 32 bp, Artificial Sequence
  Description of Artificial Sequence: Synthetic spacer oligonucleotide
gtcaattggaacatactttgagccgttcggta

SEQ ID NO: 1891 - DNA, 32 bp, Artificial Sequence
  Description of Artificial Sequence: Synthetic spacer oligonucleotide
aacatctgatgtcagcgccgtttcaatggtcc

SEQ ID NO: 1892 - DNA, 32 bp, Artificial Sequence
  Description of Artificial Sequence: Synthetic spacer oligonucleotide
gggagtcccgggcgatcctcccaaattttaac

SEQ ID NO: 1893 - DNA, 32 bp, Artificial Sequence
  Description of Artificial Sequence: Synthetic spacer oligonucleotide
acaggtataggtcgttgatatcggcaagctgg

SEQ ID NO: 1894 - DNA, 32 bp, Artificial Sequence
  Description of Artificial Sequence: Synthetic spacer oligonucleotide
atttcggatcgcagcttgctgacggtgatgaa

SEQ ID NO: 1895 - DNA, 32 bp, Artificial Sequence
  Description of Artificial Sequence: Synthetic spacer oligonucleotide
attcccgcgtcgtggtgtttgttgaactggcc

SEQ ID NO: 1896 - DNA, 32 bp, Artificial Sequence
  Description of Artificial Sequence: Synthetic spacer oligonucleotide
cctacccagtacgctgtcgccccccctgtttg

SEQ ID NO: 1897 - DNA, 32 bp, Artificial Sequence
  Description of Artificial Sequence: Synthetic spacer oligonucleotide
agttgatgaaacagttttctacgaaacgctca

SEQ ID NO: 1898 - DNA, 32 bp, Artificial Sequence
  Description of Artificial Sequence: Synthetic spacer oligonucleotide
ctgtagtaaacctgtcgccgcataaatcaccc

SEQ ID NO: 1899 - DNA, 32 bp, Artificial Sequence
  Description of Artificial Sequence: Synthetic spacer oligonucleotide
ggggcgaaaacgcgctttgaaattcgcacggt

SEQ ID NO: 1900 - DNA, 32 bp, Artificial Sequence
  Description of Artificial Sequence: Synthetic spacer oligonucleotide
acaaagatatcaataaagagttaattgtagtg

SEQ ID NO: 1901 - DNA, 32 bp, Artificial Sequence
  Description of Artificial Sequence: Synthetic spacer oligonucleotide
atccggcagcatcttgccgaatacagacagaa

SEQ ID NO: 1902 - DNA, 32 bp, Artificial Sequence
  Description of Artificial Sequence: Synthetic spacer oligonucleotide
gggagcaattttaccaacgtacccaagaattt

SEQ ID NO: 1903 - DNA, 32 bp, Artificial Sequence
  Description of Artificial Sequence: Synthetic spacer oligonucleotide
acataattgcatccccggaacctgtagtgtta

SEQ ID NO: 1904 - DNA, 32 bp, Artificial Sequence
  Description of Artificial Sequence: Synthetic spacer oligonucleotide
atctgagtgtcctaaaaaagtgacactgagag

SEQ ID NO: 1905 - DNA, 33 bp, Artificial Sequence
  Description of Artificial Sequence: Synthetic spacer oligonucleotide
tggcgtgatctggatgtttagggttgcgatatg

SEQ ID NO: 1906 - DNA, 32 bp, Artificial Sequence
  Description of Artificial Sequence: Synthetic spacer oligonucleotide
tcacgccttcaatcaagctgtctattccagaa

SEQ ID NO: 1907 - DNA, 32 bp, Artificial Sequence
  Description of Artificial Sequence: Synthetic spacer oligonucleotide
tgagcacaacatgccgatgattgcatcgtttg

SEQ ID NO: 1908 - DNA, 32 bp, Artificial Sequence
  Description of Artificial Sequence: Synthetic spacer oligonucleotide
gtgctttcgacttctttcagatttttcagcat

SEQ ID NO: 1909 - DNA, 32 bp, Artificial Sequence
  Description of Artificial Sequence: Synthetic spacer oligonucleotide
agcgagcctaaatggttggctgaggcccggcg

SEQ ID NO: 1910 - DNA, 32 bp, Artificial Sequence
  Description of Artificial Sequence: Synthetic spacer oligonucleotide
gggatatcagtgccaccgtccggacaatcgtg

SEQ ID NO: 1911 - DNA, 32 bp, Artificial Sequence
  Description of Artificial Sequence: Synthetic spacer oligonucleotide
ggttatggctgacaatgtcagtcataggttta

SEQ ID NO: 1912 - DNA, 32 bp, Artificial Sequence
  Description of Artificial Sequence: Synthetic spacer oligonucleotide
gcgaaatattggggaaaaacccctggttaacc

SEQ ID NO: 1913 - DNA, 32 bp, Artificial Sequence
  Description of Artificial Sequence: Synthetic spacer oligonucleotide
tcttttgattttgctgcgatgttatgaccaga

SEQ ID NO: 1914 - DNA, 74 bp, Artificial Sequence
  Description of Artificial Sequence: Synthetic spacer oligonucleotide
gatcgagtaacgtgcgctggaacgcgtcggcgcggggaacacaattaaagccgagggtggtaccgcgccttatt

SEQ ID NO: 1915 - DNA, 32 bp, Artificial Sequence
  Description of Artificial Sequence: Synthetic spacer oligonucleotide
aattaaagccgagggtggcaccgcgccttatt

SEQ ID NO: 1916 - DNA, 31 bp, Artificial Sequence
  Description of Artificial Sequence: Synthetic spacer oligonucleotide
accggacaaatctttttttcctgttcctgtt

SEQ ID NO: 1917 - DNA, 32 bp, Artificial Sequence
  Description of Artificial Sequence: Synthetic spacer oligonucleotide
agccagtaaataaccgtgaaatcgagatcgcc

SEQ ID NO: 1918 - DNA, 32 bp, Artificial Sequence
  Description of Artificial Sequence: Synthetic spacer oligonucleotide
atattttgtgatgtggataactaaaccacact

SEQ ID NO: 1919 - DNA, 32 bp, Artificial Sequence
  Description of Artificial Sequence: Synthetic spacer oligonucleotide
gcctgaatagatttagaaagagaaacaggtat

SEQ ID NO: 1920 - DNA, 32 bp, Artificial Sequence
  Description of Artificial Sequence: Synthetic spacer oligonucleotide
tccccacatgcataaccgtcaactaattcctg

SEQ ID NO: 1921 - DNA, 32 bp, Artificial Sequence
  Description of Artificial Sequence: Synthetic spacer oligonucleotide
tttatcatcagtgtcatgataaaaataatcaa

SEQ ID NO: 1922 - DNA, 32 bp, Artificial Sequence
  Description of Artificial Sequence: Synthetic spacer oligonucleotide
ggcagggagtggtactgcgagttagtgcctgg

SEQ ID NO: 1923 - DNA, 32 bp, Artificial Sequence
  Description of Artificial Sequence: Synthetic spacer oligonucleotide
ttttacacccccttcacctccgattgtgccac

SEQ ID NO: 1924 - DNA, 32 bp, Artificial Sequence
  Description of Artificial Sequence: Synthetic spacer oligonucleotide
agatacggcaaacctttttccccggcgccgtc

SEQ ID NO: 1925 - DNA, 33 bp, Artificial Sequence
  Description of Artificial Sequence: Synthetic spacer oligonucleotide
gcccgaaaataataattttatcaattagccagg

SEQ ID NO: 1926 - DNA, 32 bp, Artificial Sequence
  Description of Artificial Sequence: Synthetic spacer oligonucleotide
gttggacttcccccctaatatcaattgatatg

SEQ ID NO: 1927 - DNA, 33 bp, Artificial Sequence
  Description of Artificial Sequence: Synthetic spacer oligonucleotide
gcagccgattgagttcgagaaactgtcctcaat

SEQ ID NO: 1928 - DNA, 32 bp, Artificial Sequence
  Description of Artificial Sequence: Synthetic spacer oligonucleotide
atttagggtgcgcaccaattttacgcaaatcg

SEQ ID NO: 1929 - DNA, 32 bp, Artificial Sequence
  Description of Artificial Sequence: Synthetic spacer oligonucleotide
agctgcgagacgggaaaatgcactataacagt

SEQ ID NO: 1930 - DNA, 33 bp, Artificial Sequence
  Description of Artificial Sequence: Synthetic spacer oligonucleotide
cctaatgcgtagcgccggtgatgcgatctacgg

SEQ ID NO: 1931 - DNA, 32 bp, Artificial Sequence
  Description of Artificial Sequence: Synthetic spacer oligonucleotide
gccctttcaggatgtgtgctggtgggaaaaac

SEQ ID NO: 1932 - DNA, 32 bp, Artificial Sequence
  Description of Artificial Sequence: Synthetic spacer oligonucleotide
atcaccctgcttaaatgccgtcagcaccccac

SEQ ID NO: 1933 - DNA, 32 bp, Artificial Sequence
  Description of Artificial Sequence: Synthetic spacer oligonucleotide
atttctgtttggccgacataaccatcgcgaag

SEQ ID NO: 1934 - DNA, 32 bp, Artificial Sequence
  Description of Artificial Sequence: Synthetic spacer oligonucleotide
taaatttaaaattttaaatcataaaatatatt

SEQ ID NO: 1935 - DNA, 32 bp, Artificial Sequence
  Description of Artificial Sequence: Synthetic spacer oligonucleotide
taacgtggcgcggggcgtttattcctcgtttt

SEQ ID NO: 1936 - DNA, 32 bp, Artificial Sequence
  Description of Artificial Sequence: Synthetic spacer oligonucleotide
taaatgtgtctcaagtagcgggcaaagtttaa

SEQ ID NO: 1937 - DNA, 32 bp, Artificial Sequence
  Description of Artificial Sequence: Synthetic spacer oligonucleotide
gcgatcaccgttcgggcgaactggcgaatcac

SEQ ID NO: 1938 - DNA, 32 bp, Artificial Sequence
  Description of Artificial Sequence: Synthetic spacer oligonucleotide
aaaggaagtttccctttgatagagaaagcagg

SEQ ID NO: 1939 - DNA, 32 bp, Artificial Sequence
  Description of Artificial Sequence: Synthetic spacer oligonucleotide
tgttcaacatgggattatagtaatcatttttg

SEQ ID NO: 1940 - DNA, 32 bp, Artificial Sequence
  Description of Artificial Sequence: Synthetic spacer oligonucleotide
tagtaagcccccagacctgatgtgaatcgaac

SEQ ID NO: 1941 - DNA, 32 bp, Artificial Sequence
  Description of Artificial Sequence: Synthetic spacer oligonucleotide
ctgctcaaatacggtcctcatacggacctggc

SEQ ID NO: 1942 - DNA, 32 bp, Artificial Sequence
  Description of Artificial Sequence: Synthetic spacer oligonucleotide
ggctgtacataatggctcaacggagggcgatc

SEQ ID NO: 1943 - DNA, 32 bp, Artificial Sequence
  Description of Artificial Sequence: Synthetic spacer oligonucleotide
atcagcagtaacgcctaacgaagcgaagaaaa

SEQ ID NO: 1944 - DNA, 32 bp, Artificial Sequence
  Description of Artificial Sequence: Synthetic spacer oligonucleotide
ttacacgatcagccacaccgccacaaaacggg

SEQ ID NO: 1945 - DNA, 32 bp, Artificial Sequence
  Description of Artificial Sequence: Synthetic spacer oligonucleotide
attaattatatttctgcaatcctggaaggtgc

SEQ ID NO: 1946 - DNA, 32 bp, Artificial Sequence
  Description of Artificial Sequence: Synthetic spacer oligonucleotide
atacaagcaaaattatgtaagtccgttgttga

SEQ ID NO: 1947 - DNA, 32 bp, Artificial Sequence
  Description of Artificial Sequence: Synthetic spacer oligonucleotide
cacagccgttgccgctgaaacgagcgccgttt

SEQ ID NO: 1948 - DNA, 32 bp, Artificial Sequence
  Description of Artificial Sequence: Synthetic spacer oligonucleotide
actggtctggcagtaacggtcagtcctgcaaa

SEQ ID NO: 1949 - DNA, 32 bp, Artificial Sequence
  Description of Artificial Sequence: Synthetic spacer oligonucleotide
gcgccaactatcagctatgtttctgttagcct

SEQ ID NO: 1950 - DNA, 32 bp, Artificial Sequence
  Description of Artificial Sequence: Synthetic spacer oligonucleotide
ccgattaccatgaatatttctggcgccaggtg

SEQ ID NO: 1951 - DNA, 32 bp, Artificial Sequence
  Description of Artificial Sequence: Synthetic spacer oligonucleotide
ctggttcagcgtaataacgcaaaatacagttg

SEQ ID NO: 1952 - DNA, 32 bp, Artificial Sequence
  Description of Artificial Sequence: Synthetic spacer oligonucleotide
atgctggactacccgcctgaatatcgccgtaa

SEQ ID NO: 1953 - DNA, 32 bp, Artificial Sequence
  Description of Artificial Sequence: Synthetic spacer oligonucleotide
gaacctgcgggccagcatccaccgggacacct

SEQ ID NO: 1954 - DNA, 32 bp, Artificial Sequence
  Description of Artificial Sequence: Synthetic spacer oligonucleotide
caaatggacagctcctcgtcccccaggttttg

SEQ ID NO: 1955 - DNA, 32 bp, Artificial Sequence
  Description of Artificial Sequence: Synthetic spacer oligonucleotide
tccgcgctaaggcggtgccggtgtggcacttg

SEQ ID NO: 1956 - DNA, 32 bp, Artificial Sequence
  Description of Artificial Sequence: Synthetic spacer oligonucleotide
cccgaactctgttcccggttgccacccgaaac

SEQ ID NO: 1957 - DNA, 33 bp, Artificial Sequence
  Description of Artificial Sequence: Synthetic spacer oligonucleotide
ccccccggcggctaattcgccggtaatagcgcc

SEQ ID NO: 1958 - DNA, 32 bp, Artificial Sequence
  Description of Artificial Sequence: Synthetic spacer oligonucleotide
ttcctcgctatttattttctgttattaattgc

SEQ ID NO: 1959 - DNA, 32 bp, Artificial Sequence
  Description of Artificial Sequence: Synthetic spacer oligonucleotide
atccccaccggtgggcagtggatatcaaaatc

SEQ ID NO: 1960 - DNA, 32 bp, Artificial Sequence
  Description of Artificial Sequence: Synthetic spacer oligonucleotide
acgacacgatacagcgggcaattcgctacaac

SEQ ID NO: 1961 - DNA, 32 bp, Artificial Sequence
  Description of Artificial Sequence: Synthetic spacer oligonucleotide
tgcggcagcgttaacggcatttccggtgtttc

SEQ ID NO: 1962 - DNA, 32 bp, Artificial Sequence
  Description of Artificial Sequence: Synthetic spacer oligonucleotide
acttgttaagtattctacgtggttaataatac

SEQ ID NO: 1963 - DNA, 32 bp, Artificial Sequence
  Description of Artificial Sequence: Synthetic spacer oligonucleotide
ctggcgctcggcctcggtccactccagccagc

SEQ ID NO: 1964 - DNA, 32 bp, Artificial Sequence
  Description of Artificial Sequence: Synthetic spacer oligonucleotide
ttttttacgctcataaacgatgccggaatgtc

SEQ ID NO: 1965 - DNA, 32 bp, Artificial Sequence
  Description of Artificial Sequence: Synthetic spacer oligonucleotide
agtagtggagaaaaaattcttatgtcgttttt

SEQ ID NO: 1966 - DNA, 32 bp, Artificial Sequence
  Description of Artificial Sequence: Synthetic spacer oligonucleotide
taagccagcctgaagcacatttcctcagtgtg

SEQ ID NO: 1967 - DNA, 33 bp, Artificial Sequence
  Description of Artificial Sequence: Synthetic spacer oligonucleotide
tttagcactactaatcaaataaattagatttat

SEQ ID NO: 1968 - DNA, 32 bp, Artificial Sequence
  Description of Artificial Sequence: Synthetic spacer oligonucleotide
aaaatttccaacctcatattgaatttttgaat

SEQ ID NO: 1969 - DNA, 32 bp, Artificial Sequence
  Description of Artificial Sequence: Synthetic spacer oligonucleotide
ggccttttctgaatctggcgtatacgtaacca

SEQ ID NO: 1970 - DNA, 32 bp, Artificial Sequence
  Description of Artificial Sequence: Synthetic spacer oligonucleotide
taattggctcctgacaggtgtagttatgcctg

SEQ ID NO: 1971 - DNA, 32 bp, Artificial Sequence
  Description of Artificial Sequence: Synthetic spacer oligonucleotide
aacgtaatcaggatctgagtcctctgaagatt

SEQ ID NO: 1972 - DNA, 32 bp, Artificial Sequence
  Description of Artificial Sequence: Synthetic spacer oligonucleotide
caaccattggtagcaaaaacacaattattcta

SEQ ID NO: 1973 - DNA, 32 bp, Artificial Sequence
  Description of Artificial Sequence: Synthetic spacer oligonucleotide
acggttagttgaataaccgcgagtccggtcaa

SEQ ID NO: 1974 - DNA, 32 bp, Artificial Sequence
  Description of Artificial Sequence: Synthetic spacer oligonucleotide
accactcaacggcaaacggagagatcaaagag

SEQ ID NO: 1975 - DNA, 32 bp, Artificial Sequence
  Description of Artificial Sequence: Synthetic spacer oligonucleotide
ctggatgggctaaaggcgttggcggagacgga

SEQ ID NO: 1976 - DNA, 32 bp, Artificial Sequence
  Description of Artificial Sequence: Synthetic spacer oligonucleotide
cattagcgcgaaggttggcgaaattgagctgg

SEQ ID NO: 1977 - DNA, 32 bp, Artificial Sequence
  Description of Artificial Sequence: Synthetic spacer oligonucleotide
taatcgccggtttaccctcagcaatggcgcgc

SEQ ID NO: 1978 - DNA, 32 bp, Artificial Sequence
  Description of Artificial Sequence: Synthetic spacer oligonucleotide
ccttgtttatcgccagcttttcaatcattgct

SEQ ID NO: 1979 - DNA, 32 bp, Artificial Sequence
  Description of Artificial Sequence: Synthetic spacer oligonucleotide
ggagcagtggcaggcatgtcaatgaagcaagt

SEQ ID NO: 1980 - DNA, 32 bp, Artificial Sequence
  Description of Artificial Sequence: Synthetic spacer oligonucleotide
atatttataatcattaatataaatgtcgcaaa

SEQ ID NO: 1981 - DNA, 32 bp, Artificial Sequence
  Description of Artificial Sequence: Synthetic spacer oligonucleotide
atagaagaaattgaaaaggtcgagatcccgac

SEQ ID NO: 1982 - DNA, 32 bp, Artificial Sequence
  Description of Artificial Sequence: Synthetic spacer oligonucleotide
tccggaacgccgatgtaaccaccgcgctccat

SEQ ID NO: 1983 - DNA, 32 bp, Artificial Sequence
  Description of Artificial Sequence: Synthetic spacer oligonucleotide
tacgcacccgcttctccttgatttcctgatcg

SEQ ID NO: 1984 - DNA, 32 bp, Artificial Sequence
  Description of Artificial Sequence: Synthetic spacer oligonucleotide
agattctcgatcactccccgttgagcgttcgg

SEQ ID NO: 1985 - DNA, 32 bp, Artificial Sequence
  Description of Artificial Sequence: Synthetic spacer oligonucleotide
ctggtcgggcgggcggtcccggttgtagggac

SEQ ID NO: 1986 - DNA, 32 bp, Artificial Sequence
  Description of Artificial Sequence: Synthetic spacer oligonucleotide
gcatggacaacatcaacacgcagattagccag

SEQ ID NO: 1987 - DNA, 32 bp, Artificial Sequence
  Description of Artificial Sequence: Synthetic spacer oligonucleotide
tatcctggattgcaccgttaaaccattccagg

SEQ ID NO: 1988 - DNA, 32 bp, Artificial Sequence
  Description of Artificial Sequence: Synthetic spacer oligonucleotide
caacatatttataacaaatgagcggtctgtaa

SEQ ID NO: 1989 - DNA, 32 bp, Artificial Sequence
  Description of Artificial Sequence: Synthetic spacer oligonucleotide
ctgtcgacgaactaccgcgcgggtagcctggt

SEQ ID NO: 1990 - DNA, 32 bp, Artificial Sequence
  Description of Artificial Sequence: Synthetic spacer oligonucleotide
tcatattcctgtcgggcgcgctcttcaaactg

SEQ ID NO: 1991 - DNA, 32 bp, Artificial Sequence
  Description of Artificial Sequence: Synthetic spacer oligonucleotide
atgaacgtacaagaagcactcaatgtttttgg

SEQ ID NO: 1992 - DNA, 32 bp, Artificial Sequence
  Description of Artificial Sequence: Synthetic spacer oligonucleotide
ccggttaaaagagaacggcctgagcgtcgaat

SEQ ID NO: 1993 - DNA, 32 bp, Artificial Sequence
  Description of Artificial Sequence: Synthetic spacer oligonucleotide
ctggcgtacaggtacgactcgttgcgccagcg

SEQ ID NO: 1994 - DNA, 32 bp, Artificial Sequence
  Description of Artificial Sequence: Synthetic spacer oligonucleotide
atcagcgccagcttgttctcagctataaacga

SEQ ID NO: 1995 - DNA, 32 bp, Artificial Sequence
  Description of Artificial Sequence: Synthetic spacer oligonucleotide
atagcgtgttttaataccgcgcaccgaccctc

SEQ ID NO: 1996 - DNA, 32 bp, Artificial Sequence
  Description of Artificial Sequence: Synthetic spacer oligonucleotide
aaacaaaatcgtaattaattgctaggtgtgta

SEQ ID NO: 1997 - DNA, 32 bp, Artificial Sequence
  Description of Artificial Sequence: Synthetic spacer oligonucleotide
taaatcgcgttattcatctcatcgatagctgc

SEQ ID NO: 1998 - DNA, 32 bp, Artificial Sequence
  Description of Artificial Sequence: Synthetic spacer oligonucleotide
gcttttgggcgtaaggatactgcagttgcatt

SEQ ID NO: 1999 - DNA, 32 bp, Artificial Sequence
  Description of Artificial Sequence: Synthetic spacer oligonucleotide
tgataatgatttcgtttaaaaataacgaattc

SEQ ID NO: 2000 - DNA, 32 bp, Artificial Sequence
  Description of Artificial Sequence: Synthetic spacer oligonucleotide
gcggctgataaattcaaaaatggtgacgcccc

SEQ ID NO: 2001 - DNA, 32 bp, Artificial Sequence
  Description of Artificial Sequence: Synthetic spacer oligonucleotide
aagtggcagcagaacacacaaaagcattcgat

SEQ ID NO: 2002 - DNA, 32 bp, Artificial Sequence
  Description of Artificial Sequence: Synthetic spacer oligonucleotide
tcgatatagttgaaccagacgaaccaggtaaa

SEQ ID NO: 2003 - DNA, 32 bp, Artificial Sequence
  Description of Artificial Sequence: Synthetic spacer oligonucleotide
ttacagacctcctttaaaccatttttcatttg

SEQ ID NO: 2004 - DNA, 32 bp, Artificial Sequence
  Description of Artificial Sequence: Synthetic spacer oligonucleotide
gcagagatatcgcaaaaatctgtttattcgta

SEQ ID NO: 2005 - DNA, 32 bp, Artificial Sequence
  Description of Artificial Sequence: Synthetic spacer oligonucleotide
ctgctgacgctggccggctgtacccacacaac

SEQ ID NO: 2006 - DNA, 32 bp, Artificial Sequence
  Description of Artificial Sequence: Synthetic spacer oligonucleotide
cattacaaattgcaccccaaacatctgaggtg

SEQ ID NO: 2007 - DNA, 32 bp, Artificial Sequence
  Description of Artificial Sequence: Synthetic spacer oligonucleotide
aaatgcctgcaatggctaccgctgttgactcg

SEQ ID NO: 2008 - DNA, 32 bp, Artificial Sequence
  Description of Artificial Sequence: Synthetic spacer oligonucleotide
gttctggatgcccggtttgctgataagtggcc

SEQ ID NO: 2009 - DNA, 32 bp, Artificial Sequence
  Description of Artificial Sequence: Synthetic spacer oligonucleotide
acagcgccggatatggcgacggcgacggcagg

SEQ ID NO: 2010 - DNA, 32 bp, Artificial Sequence
  Description of Artificial Sequence: Synthetic spacer oligonucleotide
gggtacgcgctgcgttctcccgcctgcaacaa

SEQ ID NO: 2011 - DNA, 32 bp, Artificial Sequence
  Description of Artificial Sequence: Synthetic spacer oligonucleotide
ggcgcgagcagaagtaacgtttgaaagaatgc

SEQ ID NO: 2012 - DNA, 32 bp, Artificial Sequence
  Description of Artificial Sequence: Synthetic spacer oligonucleotide
ttcagcaacgcggctaacgtgctcctgttctg

SEQ ID NO: 2013 - DNA, 32 bp, Artificial Sequence
  Description of Artificial Sequence: Synthetic spacer oligonucleotide
cgtcggctcttttactgccgggtggtagcgtt

SEQ ID NO: 2014 - DNA, 32 bp, Artificial Sequence
  Description of Artificial Sequence: Synthetic spacer oligonucleotide
ataaacgctctcttctgccagagttcgtagcg

SEQ ID NO: 2015 - DNA, 31 bp, Artificial Sequence
  Description of Artificial Sequence: Synthetic spacer oligonucleotide
atttgcgcgacgtaacgaaaaaacgatcatc

SEQ ID NO: 2016 - DNA, 32 bp, Artificial Sequence
  Description of Artificial Sequence: Synthetic spacer oligonucleotide
tggctatcatgtaggccaactaccgcgccgca

SEQ ID NO: 2017 - DNA, 32 bp, Artificial Sequence
  Description of Artificial Sequence: Synthetic spacer oligonucleotide
cttcctgcaatgctgcaacacccgtgctcccg

SEQ ID NO: 2018 - DNA, 32 bp, Artificial Sequence
  Description of Artificial Sequence: Synthetic spacer oligonucleotide
cgctaaccccttctctttccgctggcgattct

SEQ ID NO: 2019 - DNA, 32 bp, Artificial Sequence
  Description of Artificial Sequence: Synthetic spacer oligonucleotide
ttaacgacactgcttatcattgattttattga

SEQ ID NO: 2020 - DNA, 32 bp, Artificial Sequence
  Description of Artificial Sequence: Synthetic spacer oligonucleotide
acatgactagttggtgatgttgaaaactcata

SEQ ID NO: 2021 - DNA, 32 bp, Artificial Sequence
  Description of Artificial Sequence: Synthetic spacer oligonucleotide
atgaactcaggattagtaccggttagtcgtgg

SEQ ID NO: 2022 - DNA, 32 bp, Artificial Sequence
  Description of Artificial Sequence: Synthetic spacer oligonucleotide
ctggtcatggttgagacaaacgggcctggtag

SEQ ID NO: 2023 - DNA, 32 bp, Artificial Sequence
  Description of Artificial Sequence: Synthetic spacer oligonucleotide
cggcacagacggaagctcgcaaacgtgagtta

SEQ ID NO: 2024 - DNA, 32 bp, Artificial Sequence
  Description of Artificial Sequence: Synthetic spacer oligonucleotide
tcttgttaaaaaaggcattgcagacgttttgc

SEQ ID NO: 2025 - DNA, 32 bp, Artificial Sequence
  Description of Artificial Sequence: Synthetic spacer oligonucleotide
tcaaaaatctggggagatgagggcgcgatcat

SEQ ID NO: 2026 - DNA, 32 bp, Artificial Sequence
  Description of Artificial Sequence: Synthetic spacer oligonucleotide
gggccgctttctacactcggtgatccaccaca

SEQ ID NO: 2027 - DNA, 32 bp, Artificial Sequence
  Description of Artificial Sequence: Synthetic spacer oligonucleotide
gccccctgactgatggcatcaatcagttcggg

SEQ ID NO: 2028 - DNA, 32 bp, Artificial Sequence
  Description of Artificial Sequence: Synthetic spacer oligonucleotide
aataacataatgattgatattgaagcattaga

SEQ ID NO: 2029 - DNA, 32 bp, Artificial Sequence
  Description of Artificial Sequence: Synthetic spacer oligonucleotide
cacctcgaaacggttttaaaacactaccgttt

SEQ ID NO: 2030 - DNA, 32 bp, Artificial Sequence
  Description of Artificial Sequence: Synthetic spacer oligonucleotide
ttacgacgcatcgtcaccacgtcaattaatac

SEQ ID NO: 2031 - DNA, 32 bp, Artificial Sequence
  Description of Artificial Sequence: Synthetic spacer oligonucleotide
gtggtaatactgccgctatggcccgtatttag

SEQ ID NO: 2032 - DNA, 32 bp, Artificial Sequence
  Description of Artificial Sequence: Synthetic spacer oligonucleotide
ccttgacggttcccacttatcaaatttagccc

SEQ ID NO: 2033 - DNA, 32 bp, Artificial Sequence
  Description of Artificial Sequence: Synthetic spacer oligonucleotide
gcggcaacgtcaatcacggcaccgtcaaccca

SEQ ID NO: 2034 - DNA, 32 bp, Artificial Sequence
  Description of Artificial Sequence: Synthetic spacer oligonucleotide
caacgggccagtgccgcgtcgtaaatagccaa

SEQ ID NO: 2035 - DNA, 32 bp, Artificial Sequence
  Description of Artificial Sequence: Synthetic spacer oligonucleotide
gggttaagcaccccatcatcttccgcaatcca

SEQ ID NO: 2036 - DNA, 32 bp, Artificial Sequence
  Description of Artificial Sequence: Synthetic spacer oligonucleotide
agcgggtaattacccagcacgcgcccgtccag

SEQ ID NO: 2037 - DNA, 32 bp, Artificial Sequence
  Description of Artificial Sequence: Synthetic spacer oligonucleotide
acccgcctgagtgacgaacagatccgccagct

SEQ ID NO: 2038 - DNA, 32 bp, Artificial Sequence
  Description of Artificial Sequence: Synthetic spacer oligonucleotide
cagcgtcccggtaatcggcaaaatcgcgatcc

SEQ ID NO: 2039 - DNA, 32 bp, Artificial Sequence
  Description of Artificial Sequence: Synthetic spacer oligonucleotide
cgtgttgatactgatgagacgccaatggccca

SEQ ID NO: 2040 - DNA, 33 bp, Artificial Sequence
  Description of Artificial Sequence: Synthetic spacer oligonucleotide
gcccggcaccttattgccgatttccgcgccctc

SEQ ID NO: 2041 - DNA, 34 bp, Artificial Sequence
  Description of Artificial Sequence: Synthetic spacer oligonucleotide
gactccgatctcttatagcatacgttgttgccac

SEQ ID NO: 2042 - DNA, 32 bp, Artificial Sequence
  Description of Artificial Sequence: Synthetic spacer oligonucleotide
gttcacggccagtgacaaggctccacgcctac

SEQ ID NO: 2043 - DNA, 32 bp, Artificial Sequence
  Description of Artificial Sequence: Synthetic spacer oligonucleotide
aatgacgtgctgacgtagagtgatccgccctt

SEQ ID NO: 2044 - DNA, 32 bp, Artificial Sequence
  Description of Artificial Sequence: Synthetic spacer oligonucleotide
aatatgagggtctagcaatgtcagctctttgg

SEQ ID NO: 2045 - DNA, 32 bp, Artificial Sequence
  Description of Artificial Sequence: Synthetic spacer oligonucleotide
atcgtcgtatgttgtgggtttgagggctgcgc

SEQ ID NO: 2046 - DNA, 32 bp, Artificial Sequence
  Description of Artificial Sequence: Synthetic spacer oligonucleotide
aaccctgccgccaccagccccagcggcgcttc

SEQ ID NO: 2047 - DNA, 32 bp, Artificial Sequence
  Description of Artificial Sequence: Synthetic spacer oligonucleotide
cagaggataaaaaatgaaaaattttcgtaccg

SEQ ID NO: 2048 - DNA, 32 bp, Artificial Sequence
  Description of Artificial Sequence: Synthetic spacer oligonucleotide
cgcaccaataaatatgaacaccgttttatcca

SEQ ID NO: 2049 - DNA, 32 bp, Artificial Sequence
  Description of Artificial Sequence: Synthetic spacer oligonucleotide
cttaccacttgtgttagcccggtagtaattcg

SEQ ID NO: 2050 - DNA, 32 bp, Artificial Sequence
  Description of Artificial Sequence: Synthetic spacer oligonucleotide
caccgctgccgggttgttgtcgtaaatctgcc

SEQ ID NO: 2051 - DNA, 32 bp, Artificial Sequence
  Description of Artificial Sequence: Synthetic spacer oligonucleotide
ggcttttggtcaatccgcacaatcaaacatgg

SEQ ID NO: 2052 - DNA, 32 bp, Artificial Sequence
  Description of Artificial Sequence: Synthetic spacer oligonucleotide
accgacattacggaaaaaatcagaaaggggct

SEQ ID NO: 2053 - DNA, 32 bp, Artificial Sequence
  Description of Artificial Sequence: Synthetic spacer oligonucleotide
agaacatgctccgcgaacctcatcacgcacac

SEQ ID NO: 2054 - DNA, 32 bp, Artificial Sequence
  Description of Artificial Sequence: Synthetic spacer oligonucleotide
tgtcggtattccctctttcgtggtctcgctgc

SEQ ID NO: 2055 - DNA, 32 bp, Artificial Sequence
  Description of Artificial Sequence: Synthetic spacer oligonucleotide
tttctgttattaattgccattggccaccacac

SEQ ID NO: 2056 - DNA, 32 bp, Artificial Sequence
  Description of Artificial Sequence: Synthetic spacer oligonucleotide
aaattcggtactggcagtattcctcgcgaacg

SEQ ID NO: 2057 - DNA, 32 bp, Artificial Sequence
  Description of Artificial Sequence: Synthetic spacer oligonucleotide
ctacgcgtgttgaattcgacggcataccaatg

SEQ ID NO: 2058 - DNA, 32 bp, Artificial Sequence
  Description of Artificial Sequence: Synthetic spacer oligonucleotide
aggcagtgcggatcttttccgcaagctgctgg

SEQ ID NO: 2059 - DNA, 32 bp, Artificial Sequence
  Description of Artificial Sequence: Synthetic spacer oligonucleotide
tggtggcggcgctggcaattcatgaccggggc

SEQ ID NO: 2060 - DNA, 32 bp, Artificial Sequence
  Description of Artificial Sequence: Synthetic spacer oligonucleotide
accaccgggcgttaaagcgccgtctgtcacgg

SEQ ID NO: 2061 - DNA, 32 bp, Artificial Sequence
  Description of Artificial Sequence: Synthetic spacer oligonucleotide
tcgtgaaagccctcggaggtaacttcacccgc

SEQ ID NO: 2062 - DNA, 32 bp, Artificial Sequence
  Description of Artificial Sequence: Synthetic spacer oligonucleotide
tttcatacgccatataagagggggctatatgg

SEQ ID NO: 2063 - DNA, 32 bp, Artificial Sequence
  Description of Artificial Sequence: Synthetic spacer oligonucleotide
ccatgagcggtcgcggcgaccagtatcttaaa

SEQ ID NO: 2064 - DNA, 32 bp, Artificial Sequence
  Description of Artificial Sequence: Synthetic spacer oligonucleotide
cgcagcgaactcctgataaacggaatcatcca

SEQ ID NO: 2065 - DNA, 32 bp, Artificial Sequence
  Description of Artificial Sequence: Synthetic spacer oligonucleotide
cgctgtcatgagttgcgacgcggcggaaaaca

SEQ ID NO: 2066 - DNA, 32 bp, Artificial Sequence
  Description of Artificial Sequence: Synthetic spacer oligonucleotide
ccttttgtgaccagtagacgagttgtcgcatt

SEQ ID NO: 2067 - DNA, 32 bp, Artificial Sequence
  Description of Artificial Sequence: Synthetic spacer oligonucleotide
aggttacaaagtcgatcaccgagaaatgcggg

SEQ ID NO: 2068 - DNA, 32 bp, Artificial Sequence
  Description of Artificial Sequence: Synthetic spacer oligonucleotide
ttacgaccgaaccacaccgataagaaaaacga

SEQ ID NO: 2069 - DNA, 32 bp, Artificial Sequence
  Description of Artificial Sequence: Synthetic spacer oligonucleotide
aggcagtgcgaatcttttccgcaagctgctgg

SEQ ID NO: 2070 - DNA, 32 bp, Artificial Sequence
  Description of Artificial Sequence: Synthetic spacer oligonucleotide
gtccagtgaaggggcgctcaggtgcaacctcc

SEQ ID NO: 2071 - DNA, 32 bp, Artificial Sequence
  Description of Artificial Sequence: Synthetic spacer oligonucleotide
tcactgaaaaaatcgctgacagcttttgccgc

SEQ ID NO: 2072 - DNA, 32 bp, Artificial Sequence
  Description of Artificial Sequence: Synthetic spacer oligonucleotide
tgccacaaacgctgggcgacgcacgaaaagaa

SEQ ID NO: 2073 - DNA, 32 bp, Artificial Sequence
  Description of Artificial Sequence: Synthetic spacer oligonucleotide
gttttttttccggcgcggagtaggggaggggg

SEQ ID NO: 2074 - DNA, 32 bp, Artificial Sequence
  Description of Artificial Sequence: Synthetic spacer oligonucleotide
agttcaacgctaagaattgcctcacgctatct

SEQ ID NO: 2075 - DNA, 32 bp, Artificial Sequence
  Description of Artificial Sequence: Synthetic spacer oligonucleotide
ccgccggctgaggatgtccgctggacacccag

SEQ ID NO: 2076 - DNA, 32 bp, Artificial Sequence
  Description of Artificial Sequence: Synthetic spacer oligonucleotide
aacagttaatgcggccagttctccgcctgagt

SEQ ID NO: 2077 - DNA, 32 bp, Artificial Sequence
  Description of Artificial Sequence: Synthetic spacer oligonucleotide
cattgcgggcagttgtccagatcatctaattt

SEQ ID NO: 2078 - DNA, 32 bp, Artificial Sequence
  Description of Artificial Sequence: Synthetic spacer oligonucleotide
gctccctccctgtttagtcgtagcaacaattc

SEQ ID NO: 2079 - DNA, 32 bp, Artificial Sequence
  Description of Artificial Sequence: Synthetic spacer oligonucleotide
gtgccagggggttatatcggtgagtctggaga

SEQ ID NO: 2080 - DNA, 32 bp, Artificial Sequence
  Description of Artificial Sequence: Synthetic spacer oligonucleotide
atcggcgcgctgacgtaagtcgtggccccggt

SEQ ID NO: 2081 - DNA, 32 bp, Artificial Sequence
  Description of Artificial Sequence: Synthetic spacer oligonucleotide
tgtacctgcaatatggtaaatgattatttaat

SEQ ID NO: 2082 - DNA, 32 bp, Artificial Sequence
  Description of Artificial Sequence: Synthetic spacer oligonucleotide
gaggaccgggactggacgatcaacgccctgac

SEQ ID NO: 2083 - DNA, 32 bp, Artificial Sequence
  Description of Artificial Sequence: Synthetic spacer oligonucleotide
ccaaaagtcaccacgtattatgtcgtctcctg

SEQ ID NO: 2084 - DNA, 32 bp, Artificial Sequence
  Description of Artificial Sequence: Synthetic spacer oligonucleotide
acgccggaacaacgagcagagcatgacgctgg

SEQ ID NO: 2085 - DNA, 32 bp, Artificial Sequence
  Description of Artificial Sequence: Synthetic spacer oligonucleotide
tcgtgctcctgtcgggatacctcatgggcgcc

SEQ ID NO: 2086 - DNA, 32 bp, Artificial Sequence
  Description of Artificial Sequence: Synthetic spacer oligonucleotide
aggtcgcggactggcgaggataccgggcgaac

SEQ ID NO: 2087 - DNA, 32 bp, Artificial Sequence
  Description of Artificial Sequence: Synthetic spacer oligonucleotide
tgttgtggtcatatcatgtaccgacatcgcgt

SEQ ID NO: 2088 - DNA, 32 bp, Artificial Sequence
  Description of Artificial Sequence: Synthetic spacer oligonucleotide
cagtagttatacggtttgaatgatgttgtggt

SEQ ID NO: 2089 - DNA, 32 bp, Artificial Sequence
  Description of Artificial Sequence: Synthetic spacer oligonucleotide
acctccgtcattgccgccgccttttatataat

SEQ ID NO: 2090 - DNA, 32 bp, Artificial Sequence
  Description of Artificial Sequence: Synthetic spacer oligonucleotide
tcggcccggaggttaatcccctcgcgtaccgg

SEQ ID NO: 2091 - DNA, 32 bp, Artificial Sequence
  Description of Artificial Sequence: Synthetic spacer oligonucleotide
ctgatattgaaatcccggaactcaacataact

SEQ ID NO: 2092 - DNA, 32 bp, Artificial Sequence
  Description of Artificial Sequence: Synthetic spacer oligonucleotide
aaccagttgcccgctatcgttgttccagttgc

SEQ ID NO: 2093 - DNA, 32 bp, Artificial Sequence
  Description of Artificial Sequence: Synthetic spacer oligonucleotide
gccagcagcacagccacaaggaaggatttttt

SEQ ID NO: 2094 - DNA, 32 bp, Artificial Sequence
  Description of Artificial Sequence: Synthetic spacer oligonucleotide
atcgcgctcgtaacgcaacgcctggaaaacgc

SEQ ID NO: 2095 - DNA, 32 bp, Artificial Sequence
  Description of Artificial Sequence: Synthetic spacer oligonucleotide
gtatttactgccgcccgcagaatatgtcaggt

SEQ ID NO: 2096 - DNA, 32 bp, Artificial Sequence
  Description of Artificial Sequence: Synthetic spacer oligonucleotide
tcattgggcggactcctcaaaaaaaacctcac

SEQ ID NO: 2097 - DNA, 33 bp, Artificial Sequence
  Description of Artificial Sequence: Synthetic spacer oligonucleotide
gctggtgtttgcgcgtgggaacgtggctaaagc

SEQ ID NO: 2098 - DNA, 32 bp, Artificial Sequence
  Description of Artificial Sequence: Synthetic spacer oligonucleotide
gatcccgccaaacccagcctgctggttaagat

SEQ ID NO: 2099 - DNA, 32 bp, Artificial Sequence
  Description of Artificial Sequence: Synthetic spacer oligonucleotide
ccggcttcatccatgaccctgaatttctccgg

SEQ ID NO: 2100 - DNA, 32 bp, Artificial Sequence
  Description of Artificial Sequence: Synthetic spacer oligonucleotide
atcaaatttggattggggcgatcgctactcag

SEQ ID NO: 2101 - DNA, 32 bp, Artificial Sequence
  Description of Artificial Sequence: Synthetic spacer oligonucleotide
ctcagcgtgttaacggtgaaatttgccaggcg

SEQ ID NO: 2102 - DNA, 32 bp, Artificial Sequence
  Description of Artificial Sequence: Synthetic spacer oligonucleotide
tcatcttctaaggccatgtgtgttcctttttt

SEQ ID NO: 2103 - DNA, 32 bp, Artificial Sequence
  Description of Artificial Sequence: Synthetic spacer oligonucleotide
gaattgattattgcgcataaccggctttttac

SEQ ID NO: 2104 - DNA, 32 bp, Artificial Sequence
  Description of Artificial Sequence: Synthetic spacer oligonucleotide
atcccagcgggcaatgtccatgcgcacgcggt

SEQ ID NO: 2105 - DNA, 33 bp, Artificial Sequence
  Description of Artificial Sequence: Synthetic spacer oligonucleotide
gctgcgacgaccgcagccgggtcagtgttaacc

SEQ ID NO: 2106 - DNA, 32 bp, Artificial Sequence
  Description of Artificial Sequence: Synthetic spacer oligonucleotide
gctcggtgaaaaccagtcgccccagcgcgtcg

SEQ ID NO: 2107 - DNA, 32 bp, Artificial Sequence
  Description of Artificial Sequence: Synthetic spacer oligonucleotide
gacgcgttcccaagcctcacgcaattgagcct

SEQ ID NO: 2108 - DNA, 32 bp, Artificial Sequence
  Description of Artificial Sequence: Synthetic spacer oligonucleotide
gcgccggcctcccaccccggaatagcagccgc

SEQ ID NO: 2109 - DNA, 33 bp, Artificial Sequence
  Description of Artificial Sequence: Synthetic spacer oligonucleotide
gtctggggacattcacctgcatgaccttgaggc

SEQ ID NO: 2110 - DNA, 32 bp, Artificial Sequence
  Description of Artificial Sequence: Synthetic spacer oligonucleotide
taaacagcgctgcagcggcgtttaactctgtg

SEQ ID NO: 2111 - DNA, 32 bp, Artificial Sequence
  Description of Artificial Sequence: Synthetic spacer oligonucleotide
taaacagcgctgcagcggcgtttaactccgtg

SEQ ID NO: 2112 - DNA, 32 bp, Artificial Sequence
  Description of Artificial Sequence: Synthetic spacer oligonucleotide
caaaaacatacttggcgacaagcgttttttcc

SEQ ID NO: 2113 - DNA, 32 bp, Artificial Sequence
  Description of Artificial Sequence: Synthetic spacer oligonucleotide
ccccctgctccggtgtcaatatcacctgcggt

SEQ ID NO: 2114 - DNA, 32 bp, Artificial Sequence
  Description of Artificial Sequence: Synthetic spacer oligonucleotide
tccggcagttttagccgcccattactccacgc

SEQ ID NO: 2115 - DNA, 32 bp, Artificial Sequence
  Description of Artificial Sequence: Synthetic spacer oligonucleotide
ggtttactgactacatctacagcgttgagtgt

SEQ ID NO: 2116 - DNA, 32 bp, Artificial Sequence
  Description of Artificial Sequence: Synthetic spacer oligonucleotide
gccagttcgcctttgttgcattgcacacaagg

SEQ ID NO: 2117 - DNA, 32 bp, Artificial Sequence
  Description of Artificial Sequence: Synthetic spacer oligonucleotide
ggtctttaactcaggcaggttgatatccagta

SEQ ID NO: 2118 - DNA, 32 bp, Artificial Sequence
  Description of Artificial Sequence: Synthetic spacer oligonucleotide
ccaaaaatgaggacagcaaaatgacctgtaaa

SEQ ID NO: 2119 - DNA, 32 bp, Artificial Sequence
  Description of Artificial Sequence: Synthetic spacer oligonucleotide
tcgactaacgtcagcaatcctgcccatgtcgg

SEQ ID NO: 2120 - DNA, 32 bp, Artificial Sequence
  Description of Artificial Sequence: Synthetic spacer oligonucleotide
gctttccgtttttatccgggaatatcgtttta

SEQ ID NO: 2121 - DNA, 32 bp, Artificial Sequence
  Description of Artificial Sequence: Synthetic spacer oligonucleotide
ttgcgcgccctcatatgccattttccctattg

SEQ ID NO: 2122 - DNA, 32 bp, Artificial Sequence
  Description of Artificial Sequence: Synthetic spacer oligonucleotide
tagattttgattttgaacgtatacgggtcatc

SEQ ID NO: 2123 - DNA, 32 bp, Artificial Sequence
  Description of Artificial Sequence: Synthetic spacer oligonucleotide
ctcatattgaatttttgaaccttgggggaaca

SEQ ID NO: 2124 - DNA, 32 bp, Artificial Sequence
  Description of Artificial Sequence: Synthetic spacer oligonucleotide
gttgagactttcacgtttccgttggcgtcagg

SEQ ID NO: 2125 - DNA, 32 bp, Artificial Sequence
  Description of Artificial Sequence: Synthetic spacer oligonucleotide
gttatcgtgcggatatgatcctgaatatggaa

SEQ ID NO: 2126 - DNA, 32 bp, Artificial Sequence
  Description of Artificial Sequence: Synthetic spacer oligonucleotide
tcggttgttttcaggtctgagcgtgataaaaa

SEQ ID NO: 2127 - DNA, 32 bp, Artificial Sequence
  Description of Artificial Sequence: Synthetic spacer oligonucleotide
gcatttaaggtttctgatggctcgcaaaacgt

SEQ ID NO: 2128 - DNA, 33 bp, Artificial Sequence
  Description of Artificial Sequence: Synthetic spacer oligonucleotide
gcgtgcccccgggcagcagaatatcggtcccgt

SEQ ID NO: 2129 - DNA, 33 bp, Artificial Sequence
  Description of Artificial Sequence: Synthetic spacer oligonucleotide
gttgctcattgggctgactcctcgcatttgtga

SEQ ID NO: 2130 - DNA, 32 bp, Artificial Sequence
  Description of Artificial Sequence: Synthetic spacer oligonucleotide
tcatactgaacctcgacctgattgtccaaata

SEQ ID NO: 2131 - DNA, 32 bp, Artificial Sequence
  Description of Artificial Sequence: Synthetic spacer oligonucleotide
cccttctgccccggtagtgagcaagctgctct

SEQ ID NO: 2132 - DNA, 32 bp, Artificial Sequence
  Description of Artificial Sequence: Synthetic spacer oligonucleotide
gcggcatttgaacgaaatggaagtggcggcat

SEQ ID NO: 2133 - DNA, 32 bp, Artificial Sequence
  Description of Artificial Sequence: Synthetic spacer oligonucleotide
agcatcgatcccttcatagtgcccccaaactc

SEQ ID NO: 2134 - DNA, 33 bp, Artificial Sequence
  Description of Artificial Sequence: Synthetic spacer oligonucleotide
gccaatactccccagtaaaccgccagcaccaga

SEQ ID NO: 2135 - DNA, 32 bp, Artificial Sequence
  Description of Artificial Sequence: Synthetic spacer oligonucleotide
gagcgctgttgagttaatccacgctgacgcgc

SEQ ID NO: 2136 - DNA, 32 bp, Artificial Sequence
  Description of Artificial Sequence: Synthetic spacer oligonucleotide
ttagtttgttactgttcatttaatcaatctct

SEQ ID NO: 2137 - DNA, 32 bp, Artificial Sequence
  Description of Artificial Sequence: Synthetic spacer oligonucleotide
gcaatatcgtcggcggtaagagttcgatatcc

SEQ ID NO: 2138 - DNA, 32 bp, Artificial Sequence
  Description of Artificial Sequence: Synthetic spacer oligonucleotide
cgcagtagcccaagtcatgcgcgaatcatccg

SEQ ID NO: 2139 - DNA, 32 bp, Artificial Sequence
  Description of Artificial Sequence: Synthetic spacer oligonucleotide
tgcgaggtggctacgcacatatgccagacgac

SEQ ID NO: 2140 - DNA, 32 bp, Artificial Sequence
  Description of Artificial Sequence: Synthetic spacer oligonucleotide
tattcccgcgcatcattcaagtgactgaactc

SEQ ID NO: 2141 - DNA, 32 bp, Artificial Sequence
  Description of Artificial Sequence: Synthetic spacer oligonucleotide
ttcgaataacgacgcagtatttcgcggtattg

SEQ ID NO: 2142 - DNA, 32 bp, Artificial Sequence
  Description of Artificial Sequence: Synthetic spacer oligonucleotide
ccaagggcaatgcgtttcgacagactctcgcg

SEQ ID NO: 2143 - DNA, 32 bp, Artificial Sequence
  Description of Artificial Sequence: Synthetic spacer oligonucleotide
actacgctcacagactgggattgtttcacgtg

SEQ ID NO: 2144 - DNA, 32 bp, Artificial Sequence
  Description of Artificial Sequence: Synthetic spacer oligonucleotide
cagatatccgtaaggctcctggctatccacgt

SEQ ID NO: 2145 - DNA, 32 bp, Artificial Sequence
  Description of Artificial Sequence: Synthetic spacer oligonucleotide
cggcgcaattgccacatgctttattgtcgttc

SEQ ID NO: 2146 - DNA, 32 bp, Artificial Sequence
  Description of Artificial Sequence: Synthetic spacer oligonucleotide
agctaataccacgccagcattagaaaaaccgc

SEQ ID NO: 2147 - DNA, 32 bp, Artificial Sequence
  Description of Artificial Sequence: Synthetic spacer oligonucleotide
tccaaatccggtgaggctgatatcaaacccgt

SEQ ID NO: 2148 - DNA, 32 bp, Artificial Sequence
  Description of Artificial Sequence: Synthetic spacer oligonucleotide
gctttttcggtcggcttatcggtctggtttgc

SEQ ID NO: 2149 - DNA, 32 bp, Artificial Sequence
  Description of Artificial Sequence: Synthetic spacer oligonucleotide
ccgcaatttatcgagttgcccgagcccgcagc

SEQ ID NO: 2150 - DNA, 32 bp, Artificial Sequence
  Description of Artificial Sequence: Synthetic spacer oligonucleotide
cagccagacacgtagagcgcggcgtttctggc

SEQ ID NO: 2151 - DNA, 20 bp, Artificial Sequence
  Description of Artificial Sequence: Synthetic primer
tcaacactctcttcacccag

SEQ ID NO: 2152 - DNA, 21 bp, Artificial Sequence
  Description of Artificial Sequence: Synthetic primer
taaccagccctcttctgcctg

SEQ ID NO: 2153 - DNA, 782 bp, Salmonella sp.
tgccagggcgaattgagcgccgtagccgcgatgtagtacggataatgctgccgttggtaaaagagctggcgaaggcggaaaaaacgtcctgatatgctggtgaaacgtgtttatccccgctgacgcggggaacactatttataagcgtgtcatctatgcaacccaaccggtttatccccgctggcgcggggaacacacctgcccgacccaataagggggccctcgtgacggtttatccccgctggcgcggggaacacggccgctggtcaaattcccaatctgagcaatccggtttatccccgctggcgcggggaacacatagccccggcagcgatagctaaaccagttcccggtttatccccgctggcgcggggaacacgcctcaaaatctctcggtgagatgtaagcgtccggtttatccccgctggcgcggggaacacaccagtggtcagcggcggatgaatttgccctgcggtttatccccgctggcgcggggaacacgagaatgctcatgcgcgtgagcgccatatattcggtttatccccgctggcgcggggaacacaggcggaccgaaaaaccgttttcagccaacgtcggtttatccccgctggcgcggggaacacactaaaactatatatttgttctaaaagcccttttttactacataacaaactaccaacggtaagataacaattccttatcattaaagaacattcaacttattgattttcaacaggaagaaaagaaaccaaacgcagtccatccaaatctaccggaatacg

SEQ ID NO: 2154 - DNA, 981 bp, Salmonella sp.
ccccgggaaaacgcggcctttttactttacaggtttgtaccagccattactggtacacagattatgattatgcaacggctatccttgttggcgcggggaacacggctacacgcaaaaattccagtcgttggcgcacggtttatccccgctggcgcggggaacacccgattaagatccgcagtctgcatcagtaactcggtttatccccgctggcgaggggaacaccgattctacggcaacaggccaggctgcgaccgcggtttatccccgctggcgcggggaacacatcaaacatggaaacccctttaatgagagcaacggtttatccccgctggcgcggggaacactcaggaacgcgcggcggaagagcttggtgtttgcggtttatccccgctggcgcggggaacacgctgcctttcccggagttccggcccctaaattgggtttatccccgctggcgcggggaacactcatgcgctataaaaatcagactgtcacatgccggtttatccccgctggcgcggggaacactgattattgacgacaacagcacagaccggcagcagtttatccccgctggcgcggggaacacaataatcggcaatttgtcctggacaggcacggcagtttatccccgctggcgcggggaacacgaatctggaggccaacagcgcggcgaaatcctcagtttatccccgctggcgcggggaacacactaaacgtatgtcattgtttataaactactttttatcagcaccacattccaccaacataatcgcaacaatttaaattattaaagaacagctaatttgctgattttgatgcaaaaaagttcatagaatgattttttctttaaatttaccaaaatagcgcgatccgtgcatcgctatggaaaaatttatcagcgcttttatacactcatcgaaattcacatagagaaaataaacaatgcaaggtaatggatgagtcacagacggcatc

SEQ ID NO: 2155 - DNA, 829 bp, Salmonella sp.
gagcgccgtagccgcgatgtagtacggataatgctgccgttggtaaaagagctggcgaaggcggaaaaaacgtcctgatatgctggtgaaacgtgtttatccccgctgacgcggggaacactatttataagcgtgtcatctatgcaacccaaccggtttatccccgctggcgcggggaacacacctgcccgacccaataaggaggccctcgtgacggtttatccccgctggcgcggggaacacggccgctggtcaaattcccaatctgagcaatccggtttatccccgctggcgcggggaacacatagccccggcagcgatagctaaaccagttcccggtttatccccgctggcgcggggaacacgcctcaaaatctctcggtgagatgtaagcgtccggtttatccccgctggcgcggggaacacaccagtggtcagcggcggatgaatttgccctgcggtttatccccgctggcgcggggaacacgagaatgctcatgcgcgtgagcgccatatattcggtttatccccgctggcgcggggaacaccatggcaattttacggcggacgtgctcgctctcggtttatccccgctggcgcggggaacacaggcggaccgaaaaaccgttttcagccaacgtcggtttatccccgctggcgcggggaacacactaaaactatatatttgttctaaaagcccttttttactacataacaaactaccaacggtaagataacaattccttatcattaaagaacattcaacttattgattttcaacaggaagaaaagaaaccaaacgcagtccatccaaatctaccggaatacg

SEQ ID NO: 2156 - DNA, 1055 bp, Salmonella sp.
tgtagaaaagcctcccccgggaaaacgcggcctttttactttacaggtttgtaccagccattactggtacacagattatgattatgcaacggctatccttgttggcgcggggaacacggctacacgcaaaaattccagtcgttggcgcacggtttatccccgctggcgcggggaacacccgattaagatccgcagtctgcatcagtaactcggtttatccccgctggcgaggggaacaccgattctacggcaacaggccaggctgcgaccgcggtttatccccgctggcgcggggaacacatcaaacatggaaacccctttaatgagagcaacggtttatccccgctggcgcggggaacactcaggaacgcgcggcggaagagcttggtgtttgcggtttatccccgctggcgcggggaacacgctgcctttcccggagttccggcccctaaattgggtttatccccgctggcgcggggaacactcatgcgctataaaaatcagactgtcacatgccggtttatccccgctggcgcggggaacactgattattgacgacaacagcacagaccggcagcagtttatccccgctggcgcggggaacacaataatcggcaatttgtcctggacaggcacggcagtttatccccgctggcgcggggaacacaataatcggcaatttgtcctggacaggcacggcagtttatccccgctggcgcggggaacacgaatctggaggccaacagcgcggcgaaatcctcagtttatccccgctggcgcggggaacacactaaacgtatgtcattgtttataaactactttttatcagcaccacattccaccaacataatcgcaacaatttaaattattaaagaacagctaatttgctgattttgatgcaaaaaagttcatagaatgattttttctttaaatttaccaaaatagcgcgatccgtgcatcgctatggaaaaatttatcagcgcttttatacactcatcgaaattcacatagagaaaataaacaatgcaaggtaatggatgagtcacagacggcat

SEQ ID NO: 2157 - DNA, 879 bp, Salmonella sp.
cgggagtgagcgccgtgccgcgagtagtgcggataatgctgccgttggtaaaagagctggcgaaggcggaaaaaacgtcctgatatgctggtgaaacgtgtttatccccgctggcgcggggaacatttttcagcccttgtcgactgcggaacgcccctcggtttatccccgctggcgcggggaacacgcgaaatagtggggaaaaacccctggttaacccggtttatccccgctggcgcgggaaacactaggccttgataccatcgctcgcacctcgtcacggtttatccccgctggcgcggggaacacgtttattactgcttagttaattaatgggttgccggtttatccccgctggcgcggggaacacaggcgaataatctctaatagtctcaattcgttcggtttatccccgctggcgcggggaacactaaatctggcgtcgagacattcgaaatagtgccggtttatccccgctggcgcggggaacactcttttgattttgctgcgatgttataaccagacggtttatccccgctggcgcggggaacactatccacatatacccgcaatcatattcaagaacggtttatccccgctggcgcggggaacacaatcactgcgggggtatttagcggaaacggctcggtttatccccgctggcgcggggaacaccagcacgaaaaattatttactgtcgttgctcacggtttatccccgctggcgcggggaacacactaaaactatatatttgttctaaaagcccttttttactacataacaactaccaacggtagataacaattccttattattaaagacattcaacttattgattttcaacaggaagaaaagaaacccaaacgcagtccatccaaa

The invention claimed is:

1. An in vitro method for molecular typing and/or subtyping of a bacterium of the *Salmonella* genus, using a sample, said method being characterized in that it comprises at least the following steps:
   (a) amplifying a nucleic acid fragment from a bacterium of the *Salmonella* genus, said fragment comprising the CRISPR1 locus and/or the CRISPR2 locus, using at least one set of primers, which primers have a size of less than or equal to 50 nucleotides, said sets of primers being chosen from the group consisting of:
   a set of primers "A", capable of amplifying a nucleic acid fragment comprising the CRISPR1 locus, comprising at least one forward primer A 1 constituted of an oligonucleotide sequence which exhibits at least 70% identity with, or which is identical to, a fragment of the genomic sequence of a bacterium of the *Salmonella* genus located in a region of 1000 by in a position 5' of the CRISPR1 locus, said fragment of the genomic sequence located in a position 5' of the CRISPR1 locus being of the same size as said primer A1, and at least one reverse primer A2 constituted of an oligonucleotide sequence which exhibits at least 70% identity with, or which is identical to a fragment of the genomic sequence complementary to the genomic sequence of a bacterium of the *Salmonella* genus located in a position 3' of the CRISPR1 locus and in a position 5' of the CRISPR2 locus, said complementary genomic sequence fragment being of the same size as said primer A2;
   a set of primers "B", capable of amplifying a nucleic acid fragment comprising the CRISPR2 locus, comprising at least one forward primer B1 constituted of an oligonucleotide sequence which exhibits at least 70% identity with, or which is identical to, a fragment of the genomic sequence of a bacterium of the *Salmonella* genus located in a position 3' of the CRISPR1 locus and in a position 5' of the CRISPR2 locus, said fragment of the genomic sequence located in a position 3' of the CRISPR1 locus and in a position 5' of the CRISPR2 locus being of the same size as said primer B1, and at least one reverse primer B2 constituted of an oligonucleotide sequence which exhibits at least 70% identity with, or which is identical to, a fragment of the genomic sequence complementary to the genomic sequence of a bacterium of the *Salmonella* genus located in the region of 1000 by in a position 3' of the CRISPR2 locus, said complementary genomic sequence fragment being of the same size as said primer B2;
   a set of primers "C", capable of amplifying a nucleic acid fragment comprising the CRISPR1 locus and the CRISPR2 locus, comprising at least one forward primer A1 as defined above and at least one reverse primer B2 as defined above;
   (b) determining the number and the nucleotide sequence of the variable sequences of the CRISPR1 locus and/or of the CRISPR2 locus which is (are) amplified in step (a); and
   (c) comparing said variable-sequence composition of the CRISPR1 and/or CRISPR2 loci with a reference base which provides the variable-sequence composition of the CRISPR1 and CRISPR2 loci of types and subtypes of bacteria of the *Salmonella* genus, listed in FIGS. 10 and 9, or a part of this base, 2. The method as claimed in claim 1, characterized in that the identity of the variable-sequence composition determined in step (b) with respect to a composition appearing in the reference base defined in claim 1, or a part of this base, is indicative of the type and/or of the subtype of the bacterium of the *Salmonella* genus present in the sample.

3. The method as claimed in claim 1 or claim 2, characterized in that said primers have a size of between 15 and 30 nucleotides.

4. The method as claimed in any one of claim 1, characterized in that said nucleic acid fragment comprising the CRISPR1 locus and/or the CRISPR2 locus has a size of between 400 and 20 000 bp.

5. The method as claimed in claim 1, characterized in that said fragment of the genomic sequence of a bacterium of the *Salmonella* genus located in a position 5' of the CRISPR1 locus, and/or said fragment of the genomic sequence complementary to the genomic sequence of a bacterium of the *Salmonella* genus located in a position 3' of the CRISPR2 locus, is (are) at a distance from the CRISPR1 or CRISPR2 locus of less than 500 bp, preferably less than 100 bp.

6. The method as claimed in claim 1, characterized in that said genomic sequence of a bacterium of the *Salmonella* genus is chosen from the genomic sequence of *S. enterica* serotype Typhimurium LT2 (genomic sequence available under numbers GI: 16421485 and GI: 16421501 in the GenBank database) or of *S. enterica* serotype Typhi CT18 (genomic sequence available under number GI 16503 805 in the GenBank database).

7. The method as claimed in claim 5, characterized in that the set of primers is selected from the group constituted of:
the set of primers, capable of amplifying the CRISPR1 locus, constituted of the primer of sequence SEQ ID No.: 1326, combined with at least one of the primers of sequence SEQ ID Nos: 1327, 1328, 1329, 2151 and 2152,
the set of primers, capable of amplifying the CRISPR2 locus, constituted of the primer of sequence SEQ ID No.: 1330, combined with at least one of the primers of sequence SEQ ID Nos: 1331 and 1332, and
the set of primers, capable of simultaneously amplifying the two loci CRISPR1 and CRISPR2, constituted of the primer of sequence SEQ ID No.: 1326, combined with at least one of the two primers of sequence 1331 and 1332.

8. The method as claimed in claim 1, characterized in that amplification step (a) is carried out by a method selected from the group constituted of: polymerase chain reaction (PCR), ligase chain reaction (LCR), nucleic acid sequence-based amplification (NASBA), cycling probe technology (CPT), nested PCR and multiplex PCR.

9. The method as claimed in claim 1, characterized in that step (b) is carried out using a DNA sequencing method.

10. The method as claimed in claim 1, characterized in that step (b) is carried out by:
(i) hybridization with one, several or all the set(s) of probes chosen from:
set S1-1, comprising or constituted of at least one probe comprising at least or constituted of at least 8 consecutive nucleotides of any one of the nucleic acid sequences SEQ ID Nos.: 1106 to 1119, 1123 to 1140, 1142, 1143, 1914 and/or the nucleic acid sequences complementary thereto (nucleotide sequences corresponding to the various variable sequences of the CRISPR1 locus of the serotype Typhimurium);
set S1-2, comprising or constituted of at least one probe comprising at least or constituted of at least 8 consecutive nucleotides of any one of the nucleic acid sequences SEQ ID Nos.: 455, 1144 to 1153, 1155 to 1181 and/or the nucleic acid sequences complementary thereto (nucleotide sequences corresponding to the various variable sequences of the CRISPR2 locus of the serotype Typhimurium);
set S2-1, comprising or constituted of at least one probe comprising at least one probe comprising at least 8 consecutive nucleotides of any one of the nucleic acid sequences SEQ ID Nos.: 256, 378 to 381, 383 to 387, 389 to 391, 1106, 1514, 1528, 2148 to 2153 and/or the nucleic acid sequences complementary thereto (nucleotide sequences corresponding to the various variable sequences of the CRISPR1 locus of the serotype Enteritidis);
set S2-2, comprising or constituted of at least one probe comprising at least or constituted of at least 8 consecutive nucleotides of any one of the nucleic acid sequences SEQ ID Nos.: 392 to 413, 519, 815, 972, 983, 989, 1529 to 1546, 1952 and/or the nucleic acid sequences complementary thereto (nucleotide sequences corresponding to the various variable sequences of the CRISPR2 locus of the serotype Enteritidis);
set S3-1, comprising or constituted of at least one probe comprising at least or constituted of at least 8 consecutive nucleotides of any one of the nucleic acid sequences SEQ ID Nos.: 421 to 442, 444, 445, 447 to 450 and/or the nucleic acid sequences complementary thereto (nucleotide sequences corresponding to the various variable sequences of the CRISPR1 locus of the serotype Hadar);
set S3-2, comprising or constituted of at least one probe comprising at least or constituted of at least 8 consecutive nucleotides of any one of the nucleic acid sequences SEQ ID Nos.: 451 to 465, 1144 to 1147, 1150 to 1152, 1154, 1155, 1158, 1169, 1172, 1175 to 1177, 1179, 1181 and/or the nucleic acid sequences complementary thereto (nucleotide sequences corresponding to the various variable sequences of the CRISPR2 locus of the serotype Hadar);
set S4-1, comprising or constituted of at least one probe comprising at least or constituted of at least 8 consecutive nucleotides of any one of the nucleic acid sequences SEQ ID Nos.: 65, 382, 1120, 1263 to 1302, 2024 to 2038 and/or the nucleic acid sequences complementary thereto (nucleotide sequences corresponding to the various variable sequences of the CRISPR1 locus of the serotype Virchow);
set S4-2, comprising or constituted of at least one probe comprising at least or constituted of at least 8 consecutive nucleotides of any one of 5 the nucleic acid sequences SEQ ID Nos.: 83, 93, 94, 1304 to 1324 and/or the nucleic acid sequences complementary thereto (nucleotide sequences corresponding to the various variable sequences of the CRISPR2 locus of the serotype Virchow);
set S5-1, comprising or constituted of at least one probe comprising at least or constituted of at least 8 consecutive nucleotides of any one of the nucleic acid sequences SEQ ID Nos.: 531 to 562, 1106 and/or the nucleic acid sequences complementary thereto (nucleotide sequences corresponding to the various variable sequences of the CRISPR1 locus of the serotype Infantis);
set S5-2, comprising or constituted of at least one probe comprising at least or constituted of at least 8 consecutive nucleotides of any one of the nucleic acid sequences SEQ ID Nos.: 563 to 588 and/or the nucleic acid sequences complementary thereto (nucleotide sequences corresponding to the various variable sequences of the CRISPR2 locus of the serotype Infantis);
set S6-1, comprising or constituted of at least one probe comprising at least or constituted of at least 8 consecutive nucleotides of any one of the nucleic acid sequences SEQ ID Nos.: 1254 to 1259 and/or the nucleic acid sequences complementary thereto (nucleotide sequences corresponding to the various variable sequences of the CRISPR1 locus of the serotype Typhi);

set S6-2, comprising or constituted of at least one probe comprising at least or constituted of at least 8 consecutive nucleotides of the nucleic acid sequence SEQ ID No.: 1260 and/or the nucleic acid sequence complementary thereto (nucleotide sequences corresponding to the variable sequence of the CRISPR2 locus of the serotype Typhi);

set S7-1, comprising or constituted of at least one probe comprising at least or constituted of at least 8 consecutive nucleotides of any one of the nucleic acid sequences SEQ ID Nos: 448, 449, 860 to 884, 1719 to 1724, 1727 to 1743, 1745 and/or the nucleic acid sequences complementary thereto (nucleotide sequences corresponding to the various variable sequences of the CRISPR1 locus of the serotype Newport);

set S7-2, comprising or constituted of at least one probe comprising at least or constituted of at least 8 consecutive nucleotides of any one of the nucleic acid sequences SEQ ID Nos: 453 to 456, 563, 621 622, 625, 626, 657, 885 to 896, 906 to 915, 933, 1144, 1145, 1155, 1156, 1172, 1174, 1748 to 1756, 1758, 1759, 1916 and/or the nucleic acid sequences complementary thereto (nucleotide sequences corresponding to the various variable sequences of the CRISPR2 locus of the serotype Newport);

set S8-1, comprising or constituted of at least one probe comprising at least or constituted of at least 8 consecutive nucleotides of any one of the nucleic acid sequences SEQ ID Nos: 295 to 299, 301 to 323, 738, 1106 to 1109, 1120, 1123, 1128 to 1131, 1133, 1137 to 1140, 1550, 1159 to 1561 and/or the nucleic acid sequences complementary thereto (nucleotide sequences corresponding to the various variable sequences of the CRISPR 1 locus of the serotype Derby);

set S8-2, comprising or constituted of at least one probe comprising at least or constituted of at least 8 consecutive nucleotides of any one of the nucleic acid sequences SEQ ID Nos: 324 to 337, 455, 1144, 1145, 1149 to 1153, 1155 to 1160, 1163, 1172 to 1174 and/or the nucleic acid sequences complementary thereto (nucleotide sequences corresponding to the various variable sequences of the CRISPR2 locus of the serotype Derby);

set S9-1, comprising or constituted of at least one probe comprising at least or constituted of at least 8 consecutive nucleotides of any one of the nucleic acid sequences SEQ ID Nos: 295, 307, 602 to 614, 616 to 619, 1106 1120 and/or the nucleic acid sequences complementary thereto (nucleotide sequences corresponding to the various variable sequences of the CRISPR1 locus of the serotype Kottbus);

set S9-2, comprising or constituted of at least one probe comprising at least or constituted of at least 8 consecutive nucleotides of any one of the nucleic acid sequences SEQ ID Nos: 563, 620 to 629, 885, 896, 907, 913, 914, 933 and/or the nucleic acid sequences complementary thereto (nucleotide sequences corresponding to the various variable sequences of the CRISPR2 locus of the serotype Kottbus);

set S10-1, comprising or constituted of at least one probe comprising at least or constituted of at least 8 consecutive nucleotides of any one of the nucleic acid sequences SEQ ID Nos: 422 to 425, 448 to 450, 504 to 518 and/or the nucleic acid sequences complementary thereto (nucleotide sequences corresponding to the various variable sequences of the CRISPR1 locus of the serotype Indiana);

set S10-2, comprising or constituted of at least one probe comprising at least or constituted of at least 8 consecutive nucleotides of any one of the nucleic acid sequences SEQ ID Nos: 246, 258, 269, 392, 415, 519 to 530 and/or the nucleic acid sequences complementary thereto (nucleotide sequences corresponding to the various variable sequences of the CRISPR2 locus of the serotype Indiana);

set S11-1, comprising or constituted of at least one probe comprising at least or constituted of at least 8 consecutive nucleotides of any one of the nucleic acid sequences SEQ ID Nos: 11 to 23, 238, 948, 1120, 1123, 1133 and/or the nucleic acid sequences complementary thereto (nucleotide sequences corresponding to the various variable sequences of the CRISPR1 locus of the serotype Agana);

set S11-2, comprising or constituted of at least one probe comprising at least or constituted of at least 8 consecutive nucleotides of any one of the nucleic acid sequences SEQ ID Nos: 24 to 31 and/or the nucleic acid sequences complementary thereto (nucleotide sequences corresponding to the various variable sequences of the CRISPR2 locus of the serotype Agana);

set S12-1, comprising or constituted of at least one probe comprising at least or constituted of at least 8 consecutive nucleotides of any one of the nucleic acid sequences SEQ ID Nos: 830 to 841, 1120 and/or the nucleic acid sequences complementary thereto (nucleotide sequences corresponding to the various variable sequences of the CRISPR1 locus of the serotype Napoli);

set S12-2, comprising or constituted of at least one probe comprising at least or constituted of at least 8 consecutive nucleotides of any one of the nucleic acid sequences SEQ ID Nos: 842 to 859 and/or the nucleic acid sequences complementary thereto (nucleotide sequences corresponding to the various variable sequences of the CRISPR2 locus of the serotype Napoli);

set S13-1, comprising or constituted of at least one probe comprising at least or constituted of at least 8 consecutive nucleotides of any one of the nucleic acid sequences SEQ ID Nos: 926 to 932 and/or the nucleic acid sequences complementary thereto (nucleotide sequences corresponding to the various variable sequences of the CRISPR1 locus of the serotype Paratyphi A);

set S13-2, comprising or constituted of at least one probe comprising at least or constituted of at least 8 consecutive nucleotides of any one of the nucleic acid sequences SEQ ID Nos: 933, 935, 936 and/or the nucleic acid sequences complementary thereto (nucleotide sequences corresponding to the various variable sequences of the CRISPR2 locus of the serotype Paratyphi A);

set S14-1, comprising or constituted of at least one probe comprising at least or constituted of at least 8 consecutive nucleotides of any one of the nucleic acid sequences SEQ ID Nos: 707, 937 to 971, 1106, 1128 to 1130, 1133, 1138, 1140, 1802 to 1808, 1915 and/or the nucleic acid sequences complementary thereto (nucleotide sequences corresponding to the various variable sequences of the CRISPR1 locus of the serotypes Paratyphi B and Paratyphi B Java);

set S 14-2, comprising or constituted of at least one probe comprising at least or constituted of at least 8 consecutive nucleotides of any one of the nucleic acid sequences SEQ ID Nos: 861, 972 to 987, 989 to 992 to 996, 1172, 1262, 1462, 1497, 1810 to 1825 and/or the nucleic acid sequences complementary thereto (nucleotide sequences corresponding to the various variable sequences of the CRISPR2 locus of the serotypes Paratyphi B and Paratyphi B Java);

set S15-1, comprising or constituted of at least one probe comprising at least or constituted of at least 8 consecutive nucleotides of any one of the nucleic acid sequences SEQ ID Nos: 232, 238, 239, 997 to 1002, 1106 and/or the nucleic acid sequences complementary thereto (nucleotide sequences corresponding to the various variable sequences of the CRISPR1 locus of the serotype Paratyphi C);

set S15-2, comprising or constituted of at least one probe comprising at least or constituted of at least 8 consecutive nucleotides of any one of the nucleic acid sequences SEQ ID Nos: 280, 290, 291, 392, 393, 415, 1003 to 1006, 1262 and/or the nucleic acid sequences complementary thereto (nucleotide sequences corresponding to the various variable sequences of the CRISPR2 locus of the serotype Paratyphi C);

set S16-1, comprising or constituted of at least one probe comprising at least or constituted of at least 8 consecutive nucleotides of any one of the nucleic acid sequences SEQ ID Nos: 211 to 224, 421, 427, 428, 432, 443 to 445, 447 to 449, 504 and/or the nucleic acid sequences complementary thereto (nucleotide sequences corresponding to the various variable sequences of the CRISPR1 locus of the serotype Bovismorbificans);

set S16-2, comprising or constituted of at least one probe comprising at least or constituted of at least 8 consecutive nucleotides of any one of the nucleic acid sequences SEQ ID Nos: 196 to 209, 994, 1144, 1145, 1172 and/or the nucleic acid sequences complementary thereto (nucleotide sequences corresponding to the various variable sequences of the CRISPR2 locus of the serotype Bovismorbificans);

set S17-1, comprising or constituted of at least one probe comprising at least or constituted of at least 8 consecutive nucleotides of the nucleic acid sequence SEQ ID No.: 916 and/or the nucleic acid sequence complementary thereto (nucleotide sequences corresponding to the variable sequence of the CRISPR1 locus of the serotype Panama);

set S17-2, comprising or constituted of at least one probe comprising at least or constituted of at least 8 consecutive nucleotides of any one of the nucleic acid sequences SEQ ID Nos: 918 to 925, 934 and/or the nucleic acid sequences complementary thereto (nucleotide sequences corresponding to the various variable sequences of the CRISPR2 locus of the serotype Panama);

set S18-1, comprising or constituted of at least one probe comprising at least or constituted of at least 8 consecutive nucleotides of any one of the nucleic acid sequences SEQ ID Nos: 11, 16, 67, 74, 442, 444, 446 to 448, 602, 937, 948, 1120, 1128 to 1130, 1182 to 1200, 1937 to 1950 and/or the nucleic acid sequences complementary thereto (nucleotide sequences corresponding to the various variable sequences of the CRISPR1 locus of the serotype Saintpaul);

set S18-2, comprising or constituted of at least one probe comprising at least or constituted of at least 8 consecutive nucleotides of any one of the nucleic acid sequences SEQ ID Nos: 972, 983, 989, 1201 to 1214, 1216 to 1227, 1952 to 1960 and/or the nucleic acid sequences complementary thereto (nucleotide sequences corresponding to the various variable sequences of the CRISPR2 locus of the serotype Saintpaul);

set S19-1, comprising or constituted of at least one probe comprising at least or constituted of at least 8 consecutive nucleotides of any one of the nucleic acid sequences SEQ ID Nos: 514, 1062 to 1089, 1100, 1284, 1886 to 1911 and/or the nucleic acid sequences complementary thereto (nucleotide sequences corresponding to the various variable sequences of the CRISPR1 locus of the serotype Senftenberg);

set S19-2, comprising or constituted of at least one probe comprising at least or constituted of at least 8 consecutive nucleotides of any one of the nucleic acid sequences SEQ ID Nos: 300, 1090 to 1097, 1101 to 1103, 1304, 1315, 1318 to 1320 and/or the nucleic acid sequences complementary thereto (nucleotide sequences corresponding to the various variable sequences of the CRISPR2 locus of the serotype Senftenberg);

set S20-1, comprising or constituted of at least one probe comprising at least or constituted of at least 8 consecutive nucleotides of any one of the nucleic acid sequences SEQ ID Nos: 67, 74 to 80 and/or the nucleic acid sequences complementary thereto (nucleotide sequences corresponding to the various variable sequences of the CRISPR1 locus of the serotype Anatum);

set S20-2, comprising or constituted of at least one probe comprising at least or constituted of at least 8 consecutive nucleotides of any one of the nucleic acid sequences SEQ ID Nos: 83 to 94, 1304, 1315, 1318 to 1322, 1324, 1390 to 1397 and/or the nucleic acid sequences complementary thereto (nucleotide sequences corresponding to the various variable sequences of the CRISPR2 locus of the serotype Anatum);

set S21-1, comprising or constituted of at least one probe comprising at least or constituted of at least 8 consecutive nucleotides of any one of the nucleic acid sequences SEQ ID Nos: 379, 383 to 385, 388 and/or the nucleic acid sequences complementary thereto (nucleotide sequences corresponding to the various variable sequences of the CRISPR1 locus of the serotypes Gallinarum);

set S21-2, comprising or constituted of at least one probe comprising at least or constituted of at least 8 consecutive nucleotides of any one of the nucleic acid sequences SEQ ID Nos: 392, 393, 404, 407 to 415 and/or the nucleic acid sequences complementary thereto (nucleotide sequences corresponding to the various variable sequences of the CRISPR2 locus of the serotypes Gallinarum);

set S22-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Brandenburg);

set S22-2, comprising or constituted of at least one probe comprising at least or constituted of at least 8 consecutive nucleotides of any one of the nucleic acid sequences SEQ ID Nos: 225 to 231 and/or the nucleic acid sequences complementary thereto (nucleotide sequences corresponding to the various variable sequences of the CRISPR2 locus of the serotype Brandenburg);

set S23-1, comprising or constituted of at least one probe comprising at least or constituted of at least 8 consecutive nucleotides of any one of the nucleic acid sequences SEQ ID Nos: 378, 379 and/or the nucleic acid sequences complementary thereto (nucleotide sequences corresponding to the various variable sequences of the CRISPR1 locus of the serotype Dublin);

set S23-2, comprising or constituted of at least one probe comprising at least or constituted of at least 8 consecutive nucleotides of any one of the nucleic acid sequences SEQ ID Nos: 392, 393, 411 412 and/or the nucleic acid sequences complementary thereto (nucleotide sequences corresponding to the various variable sequences of the CRISPR2 locus of the serotype Dublin);

set S24-1, comprising or constituted of at least one probe comprising at least or constituted of at least 8 consecutive nucleotides of any one of the nucleic acid sequences SEQ ID Nos: 1, 1106 and/or the nucleic acid sequences complementary thereto (nucleotide sequences corresponding to the various variable sequences of the CRISPR1 locus of the serotype Abortusequi);

set S24-2, comprising or constituted of at least one probe comprising at least or constituted of at least 8 consecutive nucleotides of any one of the nucleic acid sequences SEQ ID Nos: 2 to 10, 130 and/or the nucleic acid sequences complementary thereto (nucleotide sequences corresponding to the various variable sequences of the CRISPR2 locus of the serotype Abortusequi);

set S25-1, comprising or constituted of at least one probe comprising at least or constituted of at least 8 consecutive nucleotides of any one of the nucleic acid sequences SEQ ID Nos: 378, 379 and/or the nucleic acid sequences complementary thereto (nucleotide sequences corresponding to the various variable sequences of the CRISPR1 locus of the serotype Kiel);

set S25-2, comprising or constituted of at least one probe comprising at least or constituted of at least 8 consecutive nucleotides of any one of the nucleic acid sequences SEQ ID Nos: 392, 393, 411, 412 and/or the nucleic acid sequences complementary thereto (nucleotide sequences corresponding to the various variable sequences of the CRISPR2 locus of the serotype Kiel);

set S26-1, comprising or constituted of at least one probe comprising at least or constituted of at least 8 consecutive nucleotides of any one of the nucleic acid sequences SEQ ID Nos: 509, 510, 512 513, 637 to 660, 1086, 1107 and/or the nucleic acid sequences complementary thereto (nucleotide sequences corresponding to the various variable sequences of the CRISPR1 locus of the serotype Mbandaka);

set S26-2, comprising or constituted of at least one probe comprising at least or constituted of at least 8 consecutive nucleotides of any one of the nucleic acid sequences SEQ ID Nos: 661 to 666, 668, 669, 672, 683, 690 to 695, 25 731, 918 and/or the nucleic acid sequences complementary thereto (nucleotide sequences corresponding to the various variable sequences of the CRISPR2 locus of the serotype Mbandaka);

set S27-1, comprising or constituted of at least one probe comprising at least or constituted of at least 8 consecutive nucleotides of any one of the nucleic acid sequences SEQ ID No.: 916 and/or the nucleic acid sequence complementary thereto (nucleotide sequences corresponding to the variable sequence of the CRISPRI locus of the serotype lvliami);

set S27-2, comprising or constituted of at least one probe comprising at least or constituted of at least 8 consecutive nucleotides of any one of the nucleic acid sequences SEQ ID Nos: 25, 696 to 700 and/or the nucleic acid sequences complementary thereto (nucleotide sequences corresponding to the various variable sequences of the CRISPR2 locus of the serotype Miami);

set S28-1, comprising or constituted of at least one probe comprising at Least or constituted of at least 8 consecutive nucleotides of any one of the nucleic acid sequences SEQ ID Nos: 55, 701 to 730, 732 to 768, 1115, 1228, 1232 to 1237, 1601, 1671 to 1680, 1682 to 1694, 1747 and/or the nucleic acid sequences complementary thereto (nucleotide sequences corresponding to the various variable sequences of the CRISPR1 locus of the serotype Montevideo);

set S28-2, comprising or constituted of at least one probe comprising at least or constituted of at least 8 consecutive nucleotides of any one of the nucleic acid sequences SEQ ID Nos: 589, 769 to 829, 933, 1245, 1697, 1698 and/or the nucleic acid sequences complementary thereto (nucleotide sequences corresponding to the various variable sequences of the CRISPR2 locus of the serotype Montevideo);

set S29-1, comprising or constituted of at least one probe comprising at least or constituted of at least 8 consecutive nucleotides of any one of the nucleic acid sequences SEQ ID Nos: 379, 380, 383 to 385, 387, 389 to 391 and/or the nucleic acid sequences complementary thereto (nucleotide sequences corresponding to the various variable sequences of the CRISPR1 locus of the serotype Nitra);

set S29-2, comprising or constituted of at least one probe comprising at least or constituted of at least 8 consecutive nucleotides of any one of the nucleic acid sequences SEQ ID Nos: 392 to 394, 404, 407 to 413, 519 and/or the nucleic acid sequences complementary thereto (nucleotide sequences corresponding to the various variable sequences of the CRISPR2 locus of the serotype Nitra);

set S30-1, comprising or constituted of at least one probe comprising at least or constituted of at least 8 consecutive nucleotides of any one of the nucleic acid sequences SEQ ID Nos: 931, 932, 1104, 1105 and/or the nucleic acid sequences complementary thereto (nucleotide sequences corresponding to the various variable sequences of the CRISPR1 locus of the serotype Sendai);

set S30-2, comprising or constituted of at least one probe comprising at least or constituted of at least 8 consecutive nucleotides of the nucleic acid sequence SEQ ID No.: 936 and/or the nucleic acid sequence complementary thereto (nucleotide sequences corresponding to the variable sequence of the CRISPR2 locus of the serotype Sendai);

set S31-1, comprising or constituted of at least one probe comprising at least or constituted of at least 8 consecutive nucleotides of any one of the nucleic acid sequences SEQ ID Nos: 714 to 716, 1228 to 1239 and/or the nucleic acid sequences complementary thereto (nucleotide sequences corresponding to the various variable sequences of the CRISPR1 locus of the serotype Schwarzengnmd);

set S31-2, comprising or constituted of at least one probe comprising at least or constituted of at least 8 consecutive nucleotides of any one of the nucleic acid sequences SEQ ID Nos: 196, 992, 995, 1172, 1240 to 1244, 1246 to 1253 and/or the nucleic acid sequences complementary thereto (nucleotide sequences corresponding to the various variable sequences of the CRISPR2 locus of the serotype Schwarzengrund);

set S32-1, comprising or constituted of at least one probe comprising at least or constituted of at least 8 consecutive nucleotides of any one of the nucleic acid sequences SEQ ID Nos: 232, 238, 239, 998, 999, 1002, 1106, 1261 and/or the nucleic acid sequences complementary thereto (nucleotide sequences corresponding to the various variable sequences of the CRISPR1 locus of the serotype Typhisuis);

set S32-2, comprising or constituted of at least one probe comprising at least or constituted of at least 8 consecutive nucleotides of the nucleic acid sequence SEQ ID No.: 1262 and/or the nucleic acid sequence complementary thereto (nucleotide sequences corresponding to the variable sequence of the CRISPR2 locus of the serotype Typhisuis);

set S33-1, comprising or constituted of at least one probe comprising at least or constituted of at least 8 consecutive nucleotides of any one of the nucleic acid sequences SEQ ID Nos: 466 to 486 and/or the nucleic acid sequences complementary thereto (nucleotide sequences corresponding to the various variable sequences of the CRISPR1 locus of the various serotypes of the *houtenae* subspecies);

set S33-2, comprising or constituted of at least one probe comprising at least or constituted of at least 8 consecutive nucleotides of any one of the nucleic acid sequences SEQ ID Nos: 487 to 490 and/or the nucleic acid sequences complementary thereto (nucleotide sequences corresponding to the various variable sequences of the CRISPR2 locus of the various serotypes of the *houtenae* subspecies);

set S34-1, comprising or constituted of at least one probe comprising at least or constituted of at least 8 consecutive nucleotides of any one of the nucleic acid sequences SEQ ID Nos: 338 to 376 and/or the nucleic acid sequences complementary thereto (nucleotide sequences corresponding to the various variable sequences of the CRISPR1 locus of the various serotypes of the *diarizonae* subspecies);

set S34-2, comprising or constituted of at least one probe comprising at least or constituted of at least 8 consecutive nucleotides of the nucleic acid sequence SEQ ID No.: 377 and/or the nucleic acid sequence complementary thereto (nucleotide sequences corresponding to the variable sequence of the CRISPR2 locus of the various serotypes of the *diarizonae* subspecies);

set S35-1, comprising or constituted of at least one probe comprising at least or constituted of at least 8 consecutive nucleotides of any one of the nucleic acid sequences SEQ ID Nos: 1007 to 1037, 1848 to 1884 and/or the nucleic acid sequences complementary thereto (nucleotide sequences corresponding to the various variable sequences of the CRISPR1 locus of the *salamae* subspecies);

set S35-2, comprising or constituted of at least one probe comprising at least or constituted of at least 8 consecutive nucleotides of any one of the nucleic acid sequences SEQ ID Nos: 1038 to 1061, 1885 and/or the nucleic acid sequences complementary thereto (nucleotide sequences corresponding to the various variable sequences of the CRISPR2 locus of the *salamae* subspecies);

set S36, comprising or constituted of at least one probe comprising at least or constituted of at least 8 consecutive nucleotides of the nucleic acid sequence SEQ ID No: 95 and/or the nucleic acid sequence complementary thereto (nucleotide sequences corresponding to the variable sequence of the CRISPR1 locus of the various serotypes of the *arizonae* subspecies);

set S37-1, comprising or constituted of at least one probe comprising at least or constituted of at least 8 consecutive nucleotides of any one of the nucleic acid sequences SEQ ID Nos: 491 to 499 and/or the nucleic acid sequences complementary thereto (nucleotide sequences corresponding to the various variable sequences of the CRISPR1 locus of the various serotypes of the *indica* subspecies);

set S37-2, comprising or constituted of at least one probe comprising at least or constituted of at least 8 consecutive nucleotides of any one of the nucleic acid sequences SEQ ID Nos: 500 to 503, 1574 to 1589 and/or the nucleic acid sequences complementary thereto (nucleotide sequences corresponding to the various variable sequences of the CRISPR2 locus of the various serotypes of the *indica* subspecies);

set S38-1, comprising or constituted of at least one probe comprising at least or constituted of at least 8 consecutive nucleotides of any one of the nucleic acid sequences SEQ ID Nos: 32 to 66, 382, 416, 667, 2036 and/or the nucleic acid sequences complementary thereto (nucleotide sequences corresponding to the various variable sequences of the CRISPR1 locus of the serotype Altona);

set S38-2, comprising or constituted of at least one probe comprising at least or constituted of at least 8 consecutive nucleotides of any one of the nucleic acid sequences SEQ ID Nos: 854, 933, 1095, 1306, 1354 to 1389, 1696 and/or the nucleic acid sequences complementary thereto (nucleotide sequences corresponding to the various variable sequences of the CRISPR2 locus of the serotype Altona);

set S39-1, comprising or constituted of at least one probe comprising at least or constituted of at least 8 consecutive nucleotides of any one of the nucleic acid sequences SEQ 10 Nos: 240, 241, 1120, 1121 and/or the nucleic acid sequences complementary thereto (nucleotide sequences corresponding to the various variable sequences of the CRISPR1 locus of the serotype Choleraesuis variety Decatur);

set S39-2, comprising or constituted of at least one probe comprising at least or constituted of at least 8 consecutive nucleotides of any one of the nucleic acid sequences SEQ ID Nos: 225, 247 to 251, 253 to 256, 259 to 268, 270 to 279, 281 to 289, 292 to 294 and/or the nucleic acid sequences complementary thereto (nucleotide sequences corresponding to the various variable sequences of the CRISPR2 locus of the serotype Choleraesuis variety Decatur);

set S40-1, comprising or constituted of at least one probe comprising at least or constituted of at least 8 consecutive nucleotides of any one of the nucleic acid sequences SEQ ID Nos: 11, 232, 238, 239, 240, 242 to 245, 233 to 237, 959, 1106, 1120 and/or the nucleic acid sequences complementary thereto (nucleotide sequences corresponding to the various variable sequences of the CRISPRI locus of the serotype Choleraesuis variety Kunzendorf);

set S40-2, comprising or constituted of at least one probe comprising at least or constituted of at least 8 consecutive nucleotides of any one of the nucleic acid sequences SEQ ID Nos: 246, 252, 258, 269, 280, 290, 291, 392, 563, 933 and/or the nucleic acid sequences complementary thereto (nucleotide sequences corresponding to the various variable sequences of the CRISPR2 locus of the serotype Choleraesuis variety Kunzendorf);

set S41-1, comprising or constituted of at least one probe comprising at least or constituted of at least 8 consecutive nucleotides of any one of the nucleic acid sequences SEQ ID Nos: 11, 242 to 245, 232 to 239, 959, 1000, 1106, 1139, 1120 and/or the nucleic acid sequences complementary thereto (nucleotide sequences corresponding to the various variable sequences of the CRISPR1 locus of the serotypes Choleraesuis and Choleraesuis sensu stricto);

set S41-2, comprising or constituted of at least one probe comprising at least or constituted of at least 8 consecutive nucleotides of any one of the nucleic acid sequences SEQ ID Nos: 246, 252, 258, 269, 280, 290, 291, 392, 563, 574, 933, 1003, 1004 and/or the nucleic acid sequences complementary thereto (nucleotide sequences corresponding to the various variable sequences of the CRISPR2 locus of the serotypes Choleraesuis and Choleraesuis sensu stricto);

set S42-1, comprising or constituted of at least one probe comprising at least or constituted of at least 8 consecutive nucleotides of any one of the nucleic acid sequences SEQ ID Nos: 416 to 420, 1122 and/or the nucleic acid sequences complementary thereto (nucleotide sequences corresponding to the various variable sequences of the CRISPR1 locus of the serotype Goettingen);

set S42-2, comprising or constituted of at least one probe comprising at least or constituted of at least 8 consecutive nucleotides of the nucleic acid sequence SEQ ID No.: 1548 and/or the nucleic acid sequence complementary thereto (nucleotide sequences corresponding to the variable sequence of the CRISPR2 locus of the serotype Goettingen);

set S43-1, comprising or constituted of at least one probe comprising at least or constituted of at least 8 consecutive nucleotides of any one of the nucleic acid sequences SEQ ID Nos: 630 to 636, 937, 948, 1120, 1143 and/or the nucleic acid sequences complementary thereto (nucleotide sequences corresponding to the various variable sequences of the CRISPR1 locus of the serotype Manhattan);

set S43-2, comprising or constituted of at least one probe comprising at least or constituted of at least 8 consecutive nucleotides of any one of the nucleic acid sequences SEQ ID Nos: 392, 1653 and/or the nucleic acid sequences complementary thereto (nucleotide sequences corresponding to the various variable sequences of the CRISPR2 locus of the serotype Manhattan);

set S44-1, comprising or constituted of at least one probe comprising at least or constituted of at least 8 consecutive nucleotides of any one of the nucleic acid sequences SEQ ID Nos: 96 to 155 and/or the nucleic acid sequences complementary thereto (nucleotide sequences corresponding to the various variable sequences of the CRISPR1 locus of certain serotypes of the species *S. bongori*);

set S44-2, comprising or constituted of at least one probe comprising at least or constituted of at least 8 consecutive nucleotides of any one of the nucleic acid sequences SEQ ID Nos: 156 to 195, 1421 to 1430 and/or the nucleic acid sequences complementary thereto (nucleotide sequences corresponding to the various variable sequences of the CRISPR2 locus of certain serotypes of the species *S. bongori*);

set S45-1, comprising or constituted of at least one probe comprising at least or constituted of at least 8 consecutive nucleotides of any one of the nucleic acid sequences SEQ ID Nos: 962, 1106, 1133, 1804, 1808 and/or the nucleic acid sequences complementary thereto (nucleotide sequences corresponding to the various variable sequences of the CRISPR1 locus of the serotype Abony);

set S45-2, comprising or constituted of at least one probe comprising at least or constituted of at least 8 consecutive nucleotides of any one of the nucleic acid sequences SEQ ID Nos: 972, 989, 1334 to 1339, 1474, 1499 and/or the nucleic acid sequences complementary thereto (nucleotide sequences corresponding to the various variable sequences of the CRISPR2 locus of the serotype Abony);

set S46-1, comprising or constituted of at least one probe comprising at least or constituted of at least 8 consecutive nucleotides of any one of the nucleic acid sequences SEQ ID Nos: 448, 860 to 875, 882, 883, 1340 to 1345, 1721 to 1723 and/or the nucleic acid sequences complementary thereto (nucleotide sequences corresponding to the various variable sequences of the CRISPR1 locus of the serotype Aesch);

set S46-2, comprising or constituted of at least one probe comprising at least or constituted of at least 8 consecutive nucleotides of any one of the nucleic acid sequences SEQ ID Nos: 563, 625, 626, 885, 887 to 893, 896, 933, 1346 to 1348, 1749, 1759 and/or the nucleic acid sequences complementary thereto (nucleotide sequences corresponding to the various variable sequences of the CRISPR2 locus of the serotype Aesch);

set S47-1, comprising or constituted of at least one probe comprising at least or constituted of at least 8 consecutive nucleotides of any one of the nucleic acid sequences SEQ ID Nos: 834, 1120, 1349, 1350, 1351, 1713, 1718 and/or the nucleic acid sequences complementary thereto (nucleotide sequences corresponding to the various variable sequences of the CRISPR1 locus of the serotype Albany);

set S47-2, comprising or constituted of at least one probe comprising at least or constituted of at least 8 consecutive nucleotides of any one of the nucleic acid sequences SEQ ID Nos: 842, 852, 1352, 1353 and/or the nucleic acid sequences complementary thereto (nucleotide sequences corresponding to the various variable sequences of the CRISPR2 locus of the serotype Albany);

set S48-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Arechavalata);

set S48-2, comprising or constituted of at least one probe comprising at least or constituted of at least 8 consecutive nucleotides of any one of the nucleic acid sequences SEQ ID Nos: 225, 227 to 231, 1398 and/or the nucleic acid sequences complementary thereto (nucleotide sequences corresponding to the various variable sequences of the CRISPR2 locus of the serotype Arechavalata);

set S49-1, comprising or constituted of at least one probe comprising at least or constituted of at least 8 consecutive nucleotides of any one of the nucleic acid sequences SEQ ID Nos: 448, 449, 860, 871 to 873, 878, 895, 903 to 905, 907, 1719 to 1721, 1745 and/or the nucleic acid sequences complementary thereto (nucleotide sequences corresponding to the various variable sequences of the CRISPR1 locus of the serotype Bardo);

set S49-2, comprising or constituted of at least one probe comprising at least or constituted of at least 8 consecutive nucleotides of any one of the nucleic acid sequences SEQ ID Nos: 563, 622, 626, 885, 886 to 890, 893, 896, 907, 910 to 915, 933, 1756 to 1758 and/or the nucleic acid sequences complementary thereto (nucleotide sequences corresponding to the various variable sequences of the CRISPR2 locus of the serotype Bardo);

set S50-1, comprising or constituted of at least one probe comprising at least or constituted of at least 8 consecutive nucleotides of any one of the nucleic acid sequences SEQ ID Nos: 82, 1401 and/or the nucleic acid sequences complementary thereto (nucleotide sequences corresponding to the various variable sequences of the CRISPR1 locus of the serotype Berta);

set S50-2, comprising or constituted of at least one probe comprising at least or constituted of at least 8 consecutive nucleotides of any one of the nucleic acid sequences SEQ ID Nos: 246, 918, 933, 1401, 1448 and/or the nucleic acid sequences complementary thereto (nucleotide sequences corresponding to the various variable sequences of the CRISPR2 locus of the serotype Berta);

set S51-1, comprising or constituted of at least one probe comprising at least or constituted of at least 8 consecutive nucleotides of any one of the nucleic acid sequences SEQ ID Nos: 1, 37, 1106, 1402 to 1416, 2055 and/or the nucleic acid sequences complementary thereto (nucleotide sequences corresponding to the various variable sequences of the CRISPR1 locus of the serotype Bispebjerg);

set S51-2, comprising or constituted of at least one probe comprising at least or constituted of at least 8 consecutive nucleotides of any one of the nucleic acid sequences SEQ ID Nos: 2 to 4, 9, 1417 to 1420, 1547, 1572 and/or the nucleic acid sequences complementary thereto (nucleotide sequences corresponding to the various variable sequences of the CRISPR2 locus of the serotype Bispebjerg);

set S52-1, comprising or constituted of at least one probe comprising at least or constituted of at least 8 consecutive nucleotides of any one of the nucleic acid sequences SEQ ID Nos: 379, 380, 383, 385, 387, 389 to 391 and/or the nucleic acid sequences complementary thereto (nucleotide sequences corresponding to the various variable sequences of the CRISPR1 locus of the serotype Blegdam);

set S52-2, comprising or constituted of at least one probe comprising at least or constituted of at least 8 consecutive nucleotides of any one of the nucleic acid sequences SEQ ID Nos: 392 to 394, 404, 407, 412, 413, 519 and/or the nucleic acid sequences complementary thereto (nucleotide sequences corresponding to the various variable sequences of the CRISPR2 locus of the serotype Blegdam);

set S53-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Chester);

set S53-2, comprising or constituted of at least one probe comprising at least or constituted of at least 8 consecutive nucleotides of any one of the nucleic acid sequences SEQ ID Nos: 933, 1445 to 1447 and/or the nucleic acid sequences complementary thereto (nucleotide sequences corresponding to the various variable sequences of the CRISPR2 locus of the serotype Chester);

set S54-1, comprising or constituted of at least one probe comprising at least or constituted of at least 8 consecutive nucleotides of any one of the nucleic acid sequences SEQ ID Nos: 1449 to 1454, 1460, 1467 to 1473 and/or the nucleic acid sequences complementary thereto (nucleotide sequences corresponding to the various variable sequences of the CRISPR1 locus of the serotype Concord);

set S54-2, comprising or constituted of at least one probe comprising at least or constituted of at least 8 consecutive nucleotides of any one of the nucleic acid sequences SEQ ID Nos: 972, 1474 to 1493, 1495 to 1499 and/or the nucleic acid sequences complementary thereto (nucleotide sequences corresponding to the various variable sequences of the CRISPR2 locus of the serotype Concord);

set S55-1, comprising or constituted of at least one probe comprising at least or constituted of at least 8 consecutive nucleotides of any one of the nucleic acid sequences SEQ ID Nos: 1106, 1107 to 1109, 1123, 1128 to 1131, 1133, 1137 to 1140, 1550, 1559 to 1561 and/or the nucleic acid sequences complementary thereto (nucleotide sequences corresponding to the various variable sequences of the CRISPR1 locus of the serotype Crossness);

set S55-2, comprising or constituted of at least one probe comprising at least or constituted of at least 8 consecutive nucleotides of any one of the nucleic acid sequences SEQ ID Nos: 455, 1144, 1145, 1149 to 1153, 1155 to 1160, 1163, 1172 to 1174 and/or the nucleic acid sequences complementary thereto (nucleotide sequences corresponding to the various variable sequences of the CRISPR2 locus of the serotype Crossness);

set S56-1, comprising or constituted of at least one probe comprising at least or constituted of at least 8 consecutive nucleotides of any one of the nucleic acid sequences SEQ ID Nos: 834, 1120, 1349 to 1351 1713, 1718 and/or the nucleic acid sequences complementary thereto (nucleotide sequences corresponding to the various variable sequences of the CRISPR1 locus of the serotype Duesseldorf);

set S56-2, comprising or constituted of at least one probe comprising at least or constituted of at least 8 consecutive nucleotides of any one of the nucleic acid sequences SEQ ID Nos: 842, 852, 1352, 1353, 1501 to 1503 and/or the nucleic acid sequences complementary thereto (nucleotide sequences corresponding to the various variable sequences of the CRISPR2 locus of the serotype Duesseldorf);

set S57-1, comprising or constituted of at least one probe comprising at least or constituted of at least 8 consecutive nucleotides of any one of the nucleic acid sequences SEQ ID Nos: 941, 1504 to 1508 and/or the nucleic acid sequences complementary thereto (nucleotide sequences corresponding to the various variable sequences of the CRISPR1 locus of the serotype Emek);

set S57-2, comprising or constituted of at least one probe comprising at least or constituted of at least 8 consecutive nucleotides of any one of the nucleic acid sequences SEQ ID Nos: 1260, 1509 to 1524, 1526, 1527 and/or the nucleic acid sequences complementary thereto (nucleotide sequences corresponding to the various variable sequences of the CRISPR2 locus of the serotype Emek);

set S58-1, comprising or constituted of at least one probe comprising at least or constituted of at least 8 consecutive nucleotides of the nucleic acid sequence SEQ ID No.: 558 and/or the nucleic acid sequence complementary thereto (nucleotide sequences corresponding to the variable sequence of the CRISPR1 locus of the serotype Fulica);

set S58-2, comprising or constituted of at least one probe comprising at least or constituted of at least 8 consecutive nucleotides of any one of the nucleic acid sequences SEQ ID Nos: 2, 4, 5, 1333, 1547 and/or the nucleic acid sequences complementary thereto (nucleotide sequences corresponding to the various variable sequences of the CRISPR2 locus of the serotype Fulica);

set S59-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Gueuletapee);

set S59-2, comprising or constituted of at least one probe comprising at least or constituted of at least 8 consecutive nucleotides of any one of the nucleic acid sequences SEQ ID Nos: 597, 918 to 925, 933, 1549 and/or the nucleic acid sequences complementary thereto (nucleotide sequences corresponding to the various variable sequences of the CRISPR2 locus of the serotype Gueuletapee);

set S60-1, comprising or constituted of at least one probe comprising at least or constituted of at least 8 consecutive nucleotides of any one of the nucleic acid sequences SEQ ID Nos: 1106 to 1109, 1111 to 1116, 1118, 1123, 1128 to 1131, 1133, 1137 to 1140, 1150, 1151, 1555 to 1562 and/or the nucleic acid sequences complementary thereto (nucleotide sequences corresponding to the various variable sequences of the CRISPR1 locus of the serotype Heidelberg);

set S60-2, comprising or constituted of at least one probe comprising at least or constituted of at least 8 consecutive nucleotides of any one of the nucleic acid sequences SEQ ID Nos: 455, 1144, 1145, 1149 to 1153, 1155 to 1163, 1172 to 1174, 1563 and/or the nucleic acid sequences complementary thereto (nucleotide sequences corresponding to the various variable sequences of the CRISPR2 locus of the serotype Heidelberg);

set S61-1, comprising or constituted of at least one probe comprising at least or constituted of at least 8 consecutive nucleotides of any one of the nucleic acid sequences SEQ ID Nos: 558, 1565 to 1571 and/or the nucleic acid sequences complementary thereto (nucleotide sequences corresponding to the various variable sequences of the CRISPR1 locus of the serotype Hessarek);

set S61-2, comprising or constituted of at least one probe comprising at least or constituted of at least 8 consecutive nucleotides of any one of the nucleic acid sequences SEQ ID Nos: 2 to 4, 1547, 1572, 1573 and/or the nucleic acid sequences complementary thereto (nucleotide sequences corresponding to the various variable sequences of the CRISPR2 locus of the serotype Hessarek);

set S62-1, comprising or constituted of at least one probe comprising at least or constituted of at least 8 consecutive nucleotides of any one of the nucleic acid sequences SEQ ID Nos: 1591, 1592, 1667 and/or the nucleic acid sequences complementary thereto (nucleotide sequences corresponding to the various variable sequences of the CRISPR1 locus of the serotype Itami);

set S62-2, comprising or constituted of at least one probe comprising at least or constituted of at least 8 consecutive nucleotides of any one of the nucleic acid sequences SEQ ID Nos: 918, 1593 to 1600, 1744 and/or the nucleic acid sequences complementary thereto (nucleotide sequences corresponding to the various variable sequences of the CRISPR2 locus of the serotype Ramp;

set S63-1, comprising or constituted of at least one probe comprising at least or constituted of at least 8 consecutive nucleotides of any one of the nucleic acid sequences SEQ ID Nos: 1601 to 1606, 1687 and/or the nucleic acid sequences complementary thereto (nucleotide sequences corresponding to the various variable sequences of the CRISPR1 locus of the serotype Javiana);

set S63-2, comprising or constituted of at least one probe comprising at least or constituted of at least 8 consecutive nucleotides of any one of the nucleic acid sequences SEQ ID Nos: 589 to 601, 973, 1607, 1608 and/or the nucleic acid sequences complementary thereto (nucleotide sequences corresponding to the various variable sequences of the CRISPR2 locus of the serotype Javiana);

set S64-1, comprising or constituted of at least one probe comprising at least or constituted of at least 8 consecutive nucleotides of any one of the nucleic acid sequences SEQ ID Nos: 1609 to 1621, 1494, 1525 and/or the nucleic acid sequences complementary thereto (nucleotide sequences corresponding to the various variable sequences of the CRISPR1 locus of the serotype Johannesburg);

set S64-2, comprising or constituted of at least one probe comprising at least or constituted of at least 8 consecutive nucleotides of any one of the nucleic acid sequences SEQ ID Nos: 918, 1697, 1698 and/or the nucleic acid sequences complementary thereto (nucleotide sequences corresponding to the various variable sequences of the CRISPR2 locus of the serotype Johannesburg);

set S65-1, comprising or constituted of at least one probe comprising at least or constituted of at least 8 consecutive nucleotides of any one of the nucleic acid sequences SEQ ID Nos: 444, 448, 1184, 1622 to 1637 and/or the nucleic acid sequences complementary thereto (nucleotide sequences corresponding to the various variable sequences of the CRISPR1 locus of the serotype Kentucky);

set S65-2, comprising or constituted of at least one probe comprising at least or constituted of at least 8 consecutive nucleotides of any one of the nucleic acid sequences SEQ ID Nos: 385, 519, 1638 to 1652, 1746 and/or the nucleic acid sequences complementary thereto (nucleotide sequences corresponding to the various variable sequences of the CRISPR2 locus of the serotype Kentucky);

set S66-1, comprising or constituted of at Least one probe comprising at least or constituted of at least 8 consecutive nucleotides of the nucleic acid sequence SEQ ID No.: 67 and/or the nucleic acid sequence complementary thereto (nucleotide sequences corresponding to the variable sequence of the CRISPR1 locus of the serotype Kundunchi);

set S66-2, comprising or constituted of at least one probe comprising at least or constituted of at least 8 consecutive nucleotides of any one of the nucleic acid sequences SEQ ID Nos: 972, 983, 989, 1201, 1204, 1205, 1210 to 1212 and/or the nucleic acid sequences complementary thereto (nucleotide sequences corresponding to the various variable sequences of the CRISPR2 locus of the serotype Kundunchi);

set S67-1, comprising or constituted of at least one probe comprising at least or constituted of at least 8 consecutive nucleotides of any one of the nucleic acid sequences SEQ ID Nos: 448, 449, 860, 871, 878 to 881, 1721, 1724 and/or the nucleic acid sequences complementary thereto (nucleotide sequences corresponding to the various variable sequences of the CRISPR1 locus of the serotype Lindenburg);

set S67-2, comprising or constituted of at least one probe comprising at least or constituted of at least 8 consecutive nucleotides of any one of the nucleic acid sequences SEQ ID Nos: 563, 622, 885, 886, 896, 907, 910 to 915, 933, 1748, 1757 and/or the nucleic acid sequences complementary thereto (nucleotide sequences corresponding to the various variable sequences of the CRISPR2 locus of the serotype Lindenburg);

set S68-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Maracaibo);

set S68-2, comprising or constituted of at least one probe comprising at least or constituted of at least 8 consecutive nucleotides of any one of the nucleic acid sequences SEQ ID Nos: 1240, 1247, 1248, 1654 to 1656 and/or the nucleic acid sequences complementary thereto (nucleotide sequences corresponding to the various variable sequences of the CRISPR2 locus of the serotype Maracaibo);

set S69-1, comprising or constituted of at least one probe comprising at least or constituted of at least 8 consecutive nucleotides of any one of the nucleic acid sequences SEQ ID Nos: 627, 834, 1120, 1660 to 1669 and/or the nucleic acid sequences complementary thereto (nucleotide sequences corresponding to the various variable sequences of the CRISPR1 locus of the serotype Mississippi);

set S69-2, comprising or constituted of at least one probe comprising at least or constituted of at least 8 consecutive nucleotides of any one of the nucleic acid sequences SEQ ID Nos: 842, 1670 and/or the nucleic acid sequences complementary thereto (nucleotide sequences corresponding to the various variable sequences of the CRISPR2 locus of the serotype Mississippi);

set S70-1, comprising or constituted of at least one probe comprising at least or constituted of at least 8 consecutive nucleotides of any one of the nucleic acid sequences SEQ ID Nos: 941, 942, 949, 1699 to 1712, 2109 and/or the nucleic acid sequences complementary thereto (nucleotide sequences corresponding to the various variable sequences of the CRISPR1 locus of the serotype Muenchen);

set S70-2, comprising or constituted of at least one probe comprising at least or constituted of at least 8 consecutive nucleotides of any one of the nucleic acid sequences SEQ ID Nos: 392, 1653 and/or the nucleic acid sequences complementary thereto (nucleotide sequences corresponding to the various variable sequences of the CRISPR2 locus of the serotype Muenchen);

set S71-1, comprising or constituted of at least one probe comprising at least or constituted of at least 8 consecutive nucleotides of any one of the nucleic acid sequences SEQ ID Nos: 11, 1120, 1497, 1760 to 1775, 1809 and/or the nucleic acid sequences complementary thereto (nucleotide sequences corresponding to the various variable sequences of the CRISPR1 locus of the serotype Niarembe);

set S71-2, comprising or constituted of at least one probe comprising at least or constituted of at least 8 consecutive nucleotides of any one of the nucleic acid sequences SEQ ID Nos: 90, 1776 to 1785 and/or the nucleic acid sequences complementary thereto (nucleotide sequences corresponding to the various variable sequences of the CRISPR2 locus of the serotype Niarembe);

set S72-1, comprising or constituted of at least one probe comprising at least or constituted of at least 8 consecutive nucleotides of any one of the nucleic acid sequences SEQ ID Nos: 666, 1786 to 1791 and/or the nucleic acid sequences complementary thereto (nucleotide sequences corresponding to the various variable sequences of the CRISPR1 locus of the serotype Overvecht);

set S72-2, comprising or constituted of at least one probe comprising at least or constituted of at least 8 consecutive nucleotides of any one of the nucleic acid sequences SEQ ID Nos: 783, 1146, 1178, 1179, 1181, 1792 to 1799, 1801 and/or the nucleic acid sequences complementary thereto (nucleotide sequences corresponding to the various variable sequences of the CRISPR2 locus of the serotype Overvecht);

set S73-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Poona);

set S73-2, comprising or constituted of at least one probe comprising at least or constituted of at least 8 consecutive nucleotides of any one of the nucleic acid sequences SEQ ID Nos: 82, 87, 918, 933, 1826 and/or the nucleic acid sequences complementary thereto (nucleotide sequences corresponding to the various variable sequences of the CRISPR2 locus of the serotype Poona);

set S74-1, comprising or constituted of at least one probe comprising at least or constituted of at least 8 consecutive nucleotides of any one of the nucleic acid sequences SEQ ID Nos: 295 to 297, 307, 313, 317, 323, 1120, 1825, 1827 to 1837, 2023 and/or the nucleic acid sequences complementary thereto (nucleotide sequences corresponding to the various variable sequences of the CRISPR1 locus of the serotype Potsdam);

set S74-2, comprising or constituted of at least one probe comprising at least or constituted of at least 8 consecutive nucleotides of any one of the nucleic acid sequences SEQ ID Nos: 663, 1304, 1838 to 1847 and/or the nucleic acid sequences complementary thereto (nucleotide sequences corresponding to the various variable sequences of the CRISPR2 locus of the serotype Potsdam);

set S75-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Reading);

set S75-2, comprising or constituted of at least one probe comprising at least or constituted of at least 8 consecutive nucleotides of the nucleic acid sequence SEQ ID No.: 225 and/or the nucleic acid sequence complementary thereto (nucleotide sequences corresponding to the variable sequence of the CRISPR2 locus of the serotype Reading);

set S76-1, comprising or constituted of at least one probe comprising at least or constituted of at least 8 consecutive nucleotides of any one of the nucleic acid sequences SEQ ID Nos: 379, 380, 383 to 385, 387, 389, 390 and/or the nucleic acid sequences complementary thereto (nucleotide sequences corresponding to the various variable sequences of the CRISPR1 locus of the serotype Rosenberg);

set S76-2, comprising or constituted of at least one probe comprising at least or constituted of at least 8 consecutive nucleotides of any one of the nucleic acid sequences SEQ ID Nos: 392, 393, 404, 407 to 413 and/or the nucleic acid sequences complementary thereto (nucleotide sequences corresponding to the various variable sequences of the CRISPR2 locus of the serotype Rosenberg);

set S77-1, comprising or constituted of at least one probe comprising at least or constituted of at least 8 consecutive nucleotides of the nucleic acid sequence SEQ ID No.: 917 and/or the nucleic acid sequence complementary thereto (nucleotide sequences corresponding to the variable sequence of the CRISPR1 locus of the serotype Rubislaw);

set S77-2, comprising or constituted of at least one probe comprising at least or constituted of at least 8 consecutive nucleotides of the nucleic acid sequence SEQ ID No.: 225 and/or the nucleic acid sequence complementary thereto (nucleotide sequences corresponding to the variable sequence of the CRISPR1 locus of the serotype Rubislaw);

set S78-1, comprising or constituted of at least one probe comprising at least or constituted of at least 8 consecutive nucleotides of any one of the nucleic acid sequences SEQ ID Nos: 1525, 1609 to 1621 and/or the nucleic acid sequences complementary thereto (nucleotide sequences corresponding to the various variable sequences of the CRISPR2 locus of the serotype Sandiego);

set S78-2, comprising or constituted of at least one probe comprising at least or constituted of at least 8 consecutive nucleotides of any one of the nucleic acid sequences SEQ ID Nos: 225 to 227, 229 to 231 and/or the nucleic acid sequences complementary thereto (nucleotide sequences corresponding to the various variable sequences of the CRISPR2 locus of the serotype Sandiego);

set S79-1, comprising or constituted of at least one probe comprising at least or constituted of at least 8 consecutive nucleotides of any one of the nucleic acid sequences SEQ ID Nos: 1106, 1456, 1917 to 1924 and/or the nucleic acid sequences complementary thereto (nucleotide sequences corresponding to the various variable sequences of the CRISPR1 locus of the serotype Stourbridge);

set S79-2, comprising or constituted of at least one probe comprising at least or constituted of at least 8 consecutive nucleotides of any one of the nucleic acid sequences SEQ ID Nos: 918, 1093, 1925 to 1936 and/or the nucleic acid sequences complementary thereto (nucleotide sequences corresponding to the various variable sequences of the CRISPR2 locus of the serotype Stourbridge);

set S80-1, comprising or constituted of at least one probe comprising at least or constituted of at least 8 consecutive nucleotides of any one of the nucleic acid sequences SEQ ID Nos: 1961 to 1963 and/or the nucleic acid sequences complementary thereto (nucleotide sequences corresponding to the various variable sequences of the CRISPR1 locus of the serotype Tallahassee);

set S80-2, comprising or constituted of at least one probe comprising at least or constituted of at least 8 consecutive nucleotides of any one of the nucleic acid sequences SEQ ID Nos: 25, 603, 2127, 2133, 1964 to 1966 and/or the nucleic acid sequences complementary thereto (nucleotide sequences corresponding to the various variable sequences of the CRISPR2 locus of the serotype Tallahassee);

set S81-1, comprising or constituted of at least one probe comprising at least or constituted of at least 8 consecutive nucleotides of any one of the nucleic acid sequences SEQ ID Nos: 67, 929, 1967 to 2005 and/or the nucleic acid sequences complementary thereto (nucleotide sequences corresponding to the various variable sequences of the CRISPR1 locus of the serotype Tennessee);

set S81-2, comprising or constituted of at least one probe comprising at least or constituted of at least 8 consecutive nucleotides of any one of the nucleic acid sequences SEQ ID Nos: 24, 769, 1550, 1659, 2006 to 2022 and/or the nucleic acid sequences complementary thereto (nucleotide sequences corresponding to the various variable sequences of the CRISPR2 locus of the serotype Tennessee);

set S82-1, comprising or constituted of at least one probe comprising at least or constituted of at least 8 consecutive nucleotides of the nucleic acid sequence SEQ ID No.: 916 and/or the nucleic acid sequence complementary thereto (nucleotide sequences corresponding to the variable sequence of the CRISPR1 locus of the serotype Urbana);

set S82-2, comprising or constituted of at least one probe comprising at least or constituted of at least 8 consecutive nucleotides of any one of the nucleic acid sequences SEQ ID Nos: 1697, 1698, 1800 and/or the nucleic acid sequences complementary thereto (nucleotide sequences corresponding to the various variable sequences of the CRISPR2 locus of the serotype Urbana);

set S83-1, comprising or constituted of at least one probe comprising at least or constituted of at least 8 consecutive nucleotides of any one of the nucleic acid sequences SEQ ID Nos; 948, 1120, 1123, 1325, 2039 to 2078 and/or the nucleic acid sequences complementary thereto (nucleotide sequences corresponding to the various variable sequences of the CRISPR1 locus of the serotype Weltevreden);

set S83-2, comprising or constituted of at least one probe comprising at least or constituted of at least 8 consecutive nucleotides of any one of the nucleic acid sequences SEQ ID Nos: 254 to 256, 2079 to 2108 and/or the nucleic acid sequences complementary thereto (nucleotide sequences corresponding to the various variable sequences of the CRISPR2 locus of the serotype Weltevreden);

set S84-1, comprising or constituted of at least one probe comprising at least or constituted of at least 8 consecutive nucleotides of any one of the nucleic acid sequences SEQ ID Nos: 1312, 1690, 2141, 2142 and/or the nucleic acid sequences complementary thereto (nucleotide sequences corresponding to the various variable sequences of the CRISPR1 locus of the serotype Zaiman);

set S84-2, comprising or constituted of at least one probe comprising at least or constituted of at least 8 consecutive nucleotides of any one of the nucleic acid sequences SEQ ID Nos: 1697, 1698, 1800, 1924, 2143, 2144 and/or the nucleic acid sequences complementary thereto (nucleotide sequences corresponding to the various variable sequences of the CRISPR2 locus of the serotype Zaiman); and (ii) detection of the hybridized probes.

11. The method as claimed in claim 10, characterized in that the probes have a length of between 8 and 76 nucleotides, preferably between 8 and 34 nucleotides.

12. The method as claimed in claim 10 or claim 11, characterized in that said step (b) is carried out by hybridization of at least one probe of each of sets S1-1 to S6-2.

13. The method as claimed in claim 12, characterized in that said step (b) is carried out by hybridization, in addition, of at least one probe of each of sets S7-1 to S10-2.

14. The method as claimed in claim 13, characterized in that said step (b) is carried out by hybridization of at least one probe of each of sets S1-1 to S44-2.

15. The method as claimed in claim 1, characterized in that the amplified nucleic acid fragments are labeled.

16. The method as claimed in claim 1, characterized in that the sample is an isolated bacterial strain of the *Salmonella* genus.

17. The method as claimed in claim 1, characterized in that step (a) is preceded by a step of extraction of nucleic acids present in said sample.

* * * * *

UNITED STATES PATENT AND TRADEMARK OFFICE
CERTIFICATE OF CORRECTION

PATENT NO. : 8,673,568 B2
APPLICATION NO. : 12/811055
DATED : March 18, 2014
INVENTOR(S) : François-Xavier Weill et al.

It is certified that error appears in the above-identified patent and that said Letters Patent is hereby corrected as shown below:

IN THE CLAIMS:

Claim 1, col. 41, line 49, "1000 by" should read --1000 bp--.

Claim 1, col. 42, line 40, "1000 by" should read --1000 bp--.

Claim 1, col. 42, line 47, "A1as" should read --A1 as--.

Claim 4, col. 43, line 1, "as claimed in any one of claim 1" should read --as claimed in claim 1--.

Claim 10, col. 46, line 19, "serotype Agana" should read --serotype Agona--.

Claim 10, col. 50, line 2, "CRISPRI" should read --CRISPR1--.

Claim 10, col. 50, line 3, "serotype lvliami" should read --serotype Miami--.

Claim 10, col. 50, line 14, "at Least" should read --at least--.

Claim 10, col. 50, line 67, "serotype Schwarzengnmd" should read --serotype Schwarzengrund--.

Claim 10, col. 53, line 2, "CRISPRI" should read --CRISPR1--.

Claim 10, col. 58, line 27, "serotype Ramp" should read --serotype Itami--.

Claim 10, col. 59, line 9, "at Least" should read --at least--.

Claim 10, col. 60, line 10, "CRISPRI" should read --CRISPR1--.

Signed and Sealed this
Twenty-fourth Day of June, 2014

Michelle K. Lee
*Deputy Director of the United States Patent and Trademark Office*